United States Patent 11,326,182 (COMPOSITIONS FOR THE TREATMENT OF DISEASE) - sequence listing, part 3

SEQ ID NO: 14496 - protein, 397 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSGGGGSGGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14497 - protein, 125 aa, Artificial Sequence
  Description of Artificial Sequence: Synthetic polypeptide
  Recombinant Polypeptide
EVQLQASGGGLVQAGGSLRLSCSASVRTFSIYAMGWFRQAPGKEREFVAGINRSGDVTKYADFVKGRFSISRDNAKNMVYLQMNSLKPEDTALYYCAATWAYDTVGALTSGYNFWGQGTQVTVSS

SEQ ID NO: 14498 - protein, 122 aa, Artificial Sequence
  Description of Artificial Sequence: Synthetic polypeptide
  Recombinant Polypeptide
EVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSTSTATPLRVDYWGKGTQVTVSS

SEQ ID NO: 14499 - protein, 114 aa, Artificial Sequence
  Description of Artificial Sequence: Synthetic polypeptide
  Recombinant Polypeptide
EVQLVESGGGLVQPGGSLRLSCAASGSIFTFNAMGWYRQAPGKQRELVAVIISGGSTHYVDSVKGRFTISRDNAKKMVYLQMNSLKPEDTAVYYCNVKKFGDYWGQGTQVTVSS

SEQ ID NO: 14500 - protein, 116 aa, Artificial Sequence
  Description of Artificial Sequence: Synthetic polypeptide
  Recombinant Polypeptide
DVQLVESGGGLVQAGGSLRLSCAASESISTINVMAWYRQAPGKQRELVAEITRSGRTNYVDSVKGRFTISRDNAKNTMYLQMNSLNLEDTAVYYCRTIDGSWREYWGQGTQVTVSS

SEQ ID NO: 14501 - protein, 125 aa, Artificial Sequence
  Description of Artificial Sequence: Synthetic polypeptide
  Recombinant Polypeptide
QVKLEESGGGLVQPGGSLRLSCVASGRTFSNYAMGWFRQAPGQEREFVAAINWNSRSTYYADSVKGRFTISRLNARNTVYLQMNRLKPEDTAVYDCAASHDSDYGGTNANLYDYWGQGTQVTVSS

SEQ ID NO: 14502 - protein, 124 aa, Artificial Sequence
  Description of Artificial Sequence: Synthetic polypeptide
  Recombinant Polypeptide
QVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSS

SEQ ID NO: 14503 - protein, 120 aa, Artificial Sequence
  Description of Artificial Sequence: Synthetic polypeptide
  Nanobody
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 14504 - protein, 119 aa, Artificial Sequence
  Description of Artificial Sequence: Synthetic polypeptide
  Nanobody
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 14505 - protein, 114 aa, Artificial Sequence
  Description of Artificial Sequence: Synthetic polypeptide
  Nanobody
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 14506 - protein, 127 aa, Artificial Sequence
  Description of Artificial Sequence: Synthetic polypeptide
  Nanobody
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 14507 - protein, 113 aa, Artificial Sequence
  Description of Artificial Sequence: Synthetic polypeptide
  Nanobody
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 14508 - protein, 118 aa, Artificial Sequence
  Description of Artificial Sequence: Synthetic polypeptide
  Nanobody
  MOD_RES (27)..(27): Any amino acid
  MOD_RES (32)..(32): Any amino acid
  MOD_RES (75)..(75): Any amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 14509 - protein, 111 aa, Artificial Sequence
  Description of Artificial Sequence: Synthetic polypeptide
  Nanobody
EVQLVESGGGLVQAGGSLTISCAASGITFSDSIVSWYRRARGKQREWVAGISNGGTTKYAESVLGRFTISRDNAKNMVYLQMNGLNPEDTAVYLCKVRQYWGQGTQVTVSS

SEQ ID NO: 14510 - protein, 114 aa, Artificial Sequence
  Description of Artificial Sequence: Synthetic polypeptide
  Nanobody
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 14511 - protein, 126 aa, Artificial Sequence
  Description of Artificial Sequence: Synthetic polypeptide
  Nanobody
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 14512 - protein, 123 aa, Artificial Sequence
  Description of Artificial Sequence: Synthetic polypeptide
  Nanobody
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 14513 - protein, 124 aa, Artificial Sequence
  Description of Artificial Sequence: Synthetic polypeptide
  Nanobody
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 14514 - protein, 115 aa, Artificial Sequence
  Description of Artificial Sequence: Synthetic polypeptide
  Nanobody
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 14515 - protein, 249 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14516 - protein, 254 aa, Artificial Sequence
  Description of Artificial Sequence: Synthetic polypeptide
  Nanobody sequence
EVQLVESGGGLVQAGGSLRLSCAASGRTISRYTMGWFRQAPGKEREFVAAISWSGDNTNYADSVKGRFTISRPNTKNTMYLQMNSLKPEDTAVYYCAADYRSGSYYQASEWTRPSGYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14517 - protein, 249 aa, Artificial Sequence
  Description of Artificial Sequence: Synthetic polypeptide
  Nanobody sequence
EVQLVESGGGLVQPGGSLRLSCAASGFSLDYFAIGWFRQAPGKEREEISCISNSDGSTYYANSVKGRFTISIDNAKNTVYLQMTSLKPEDTAVYYCATPVGLGPFCKTTNDYDYSGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14518 - protein, 248 aa, Artificial Sequence
  Description of Artificial Sequence: Synthetic polypeptide
  Nanobody sequence
EVQLVESGGGLVQPGGSLRLSCAASGFTLDYYAINWFRQAPGKEREGVSCISGGDGSTYYADSVKGRFTISRDNAKNTVYLQMNSLKPEDTAVYYCATALGLSSSCHGDGYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14519 - protein, 275 aa, Artificial Sequence
  Description of Artificial Sequence: Synthetic polypeptide
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSS

SEQ ID NO: 14520 - protein, 249 aa, Artificial Sequence
  Description of Artificial Sequence: Synthetic polypeptide
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSS

SEQ ID NO: 14521 - protein, 125 aa, Artificial Sequence
  Description of Artificial Sequence: Synthetic polypeptide
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSS

SEQ ID NO: 14522 - protein, 249 aa, Artificial Sequence
  Description of Artificial Sequence: Synthetic polypeptide
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSGGGGSGGGSEVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSS

SEQ ID NO: 14523 - protein, 249 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSSGGGGSGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSS

SEQ ID NO: 14524 - protein, 249 aa, Artificial Sequence
  Description of Artificial Sequence: Synthetic polypeptide
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSGGGGSGGGSDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSS

SEQ ID NO: 14525 - protein, 249 aa, Artificial Sequence
  Description of Artificial Sequence: Synthetic polypeptide
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSGGGGSGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSS

SEQ ID NO: 14526 - protein, 275 aa, Artificial Sequence
  Description of Artificial Sequence: Synthetic polypeptide
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSGGGGSGGGGSGGGGSGGGGSGGGGSGGGGSGGGGSEVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSS

SEQ ID NO: 14527 - protein, 275 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSSGGGGSGGGGSGGGGSGGGGSGGGGSGGGGSGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSS

SEQ ID NO: 14528 - protein, 275 aa, Artificial Sequence
  Description of Artificial Sequence: Synthetic polypeptide
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSGGGGSGGGGSGGGGSGGGGSGGGGSGGGGSGGGGSDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSS

SEQ ID NO: 14529 - protein, 275 aa, Artificial Sequence
  Description of Artificial Sequence: Synthetic polypeptide
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSGGGGSGGGGSGGGGSGGGGSGGGGSGGGGSGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSS

SEQ ID NO: 14530 - protein, 383 aa, Artificial Sequence
  Description of Artificial Sequence: Synthetic polypeptide
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSGGGGSGGGSDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSGGGGSGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSS

SEQ ID NO: 14531 - protein, 283 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGAADYKDHDGDYKDHDIDYKDDDDKGAAHHHHHH

SEQ ID NO: 14532 - protein, 249 aa, Artificial Sequence
  Description of Artificial Sequence: Synthetic polypeptide
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14533 - protein, 158 aa, Artificial Sequence
  Description of Artificial Sequence: Synthetic polypeptide
  Nanobody sequence
VQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSSAAADYKDHDGDYKDHDIDYKDDDDKGAAHHHHHH

SEQ ID NO: 14534 - protein, 159 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNSKNTVYLQMNSLRPEDTGVYYCATPIGLSSSCLLEYDYDYWGQGTLVTVSSAAADYKDHDGDYKDHDIDYKDDDDKGAAHHHHHH

SEQ ID NO: 14535 - protein, 159 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSAAADYKDHDGDYKDHDIDYKDDDDKGAAHHHHHH

SEQ ID NO: 14536 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISSSNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14537 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISSSNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14538 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISSDNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14539 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISSDNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14540 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISRSNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14541 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISRDNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14542 - protein, 157 aa, Artificial Sequence
  Description of Artificial Sequence: Synthetic polypeptide
  Nanobody sequence
VQLVESGGGLVQPGGSLRLSCAASGFTFDDYAIGWFRQAPGEEREGVSSISSTYGLTYYADSVKGRFTISRSNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14543 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISRDNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14544 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISSSNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14545 - protein, 201 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISSSNSKNTVYLQMNSLKPEDTAVYYCAATPIERLGLDAYEYDYWGQGTLVTVSSAAADYKDHDGDYKDHDIDYKDDDDKGAAHHHHHHEVQLVESGGGLVQPGGSLRLSCAASGFTFDDYAIGWFRQAPGK

SEQ ID NO: 14546 - protein, 115 aa, Artificial Sequence
  Description of Artificial Sequence: Synthetic polypeptide
  Nanobody sequence
EREGVSSISSTYGLTYYADSVKGRFTISSDNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14547 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISSDNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14548 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISRSNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14549 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISRDNSKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14550 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISRSNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14551 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISRDNSKNTVYLQMNSLKPEDTAVYYCAATPIERLGLDAYEYDYWGQGTLVTVSSAAADYKDHDGDYKDHDIDYKDDDDKGAAHHHHHH

SEQ ID NO: 14552 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14553 - protein, 158 aa, Artificial Sequence
  Description of Artificial Sequence: Synthetic polypeptide
  Nanobody sequence
EVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14554 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKEREGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14555 - protein, 158 aa, Artificial Sequence
  Description of Artificial Sequence: Synthetic polypeptide
  Nanobody sequence
EVQLVESGGGLVQPGGSLRLSCAASGFAFDDYAIGWFRQAPGKEREGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14556 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEERLGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14557 - protein, 158 aa, Artificial Sequence
  Description of Artificial Sequence: Synthetic polypeptide
  Nanobody sequence
EVQLVESGGGLVQPGGSLRLSCAASGFAFDDYAIGWFRQAPGEERLGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14558 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGKERLGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14559 - protein, 158 aa, Artificial Sequence
  Description of Artificial Sequence: Synthetic polypeptide
  Nanobody sequence
EVQLVESGGGLVQPGGSLRLSCAASGFAFDDYAIGWFRQAPGKERLGVSSISSTYGLTYYADSVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14560 - protein, 158 aa, Artificial Sequence
  Description of Artificial Sequence: Synthetic polypeptide
  Nanobody sequence
EVQLVESGGGLVQPGGSLRLSCAASGFTFDDYAIGWFRQAPGEEREGVSSISSTYGLTYYADPVKGRFTISSDNSKNTVYLQMNSLRPEDTAVYYCAATPIGLIGLDAYEYDYWGQGTLVTVSSAAADYKDHDGDYKDHDIDYKDDDDKGAAHHHHHH

SEQ ID NO: 14561 - protein, 249 aa, Artificial Sequence
  Description of Artificial Sequence: Synthetic polypeptide
  Nanobody sequence
DVQLVESGGGLVQPGGSLRLSCAASGFTFDDYAIGWFRQAPGEEREGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14562 - protein, 249 aa, Artificial Sequence
  Description of Artificial Sequence: Synthetic polypeptide
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14563 - protein, 249 aa, Artificial Sequence
  Description of Artificial Sequence: Synthetic polypeptide
  Nanobody sequence
DVQLVESGGGLVQPGGSLRLSCAASGFTFDDYAIGWFRQAPGKEREGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14564 - protein, 249 aa, Artificial Sequence
  Description of Artificial Sequence: Synthetic polypeptide
  Nanobody sequence
DVQLVESGGGLVQPGGSLRLSCAASGFAFDDYAIGWFRQAPGKEREGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14565 - protein, 249 aa, Artificial Sequence
  Description of Artificial Sequence: Synthetic polypeptide
  Nanobody sequence
DVQLVESGGGLVQPGGSLRLSCAASGFTFDDYAIGWFRQAPGEERLGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14566 - protein, 249 aa, Artificial Sequence
  Description of Artificial Sequence: Synthetic polypeptide
  Nanobody sequence
DVQLVESGGGLVQPGGSLRLSCAASGFAFDDYAIGWFRQAPGEERLGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14567 - protein, 249 aa, Artificial Sequence
  Description of Artificial Sequence: Synthetic polypeptide
  Nanobody sequence
DVQLVESGGGLVQPGGSLRLSCAASGFTFDDYAIGWFRQAPGKERLGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14568 - protein, 249 aa, Artificial Sequence
  Description of Artificial Sequence: Synthetic polypeptide
  Nanobody sequence
DVQLVESGGGLVQPGGSLRLSCAASGFAFDDYAIGWFRQAPGKERLGVSSISSTYGLTYYADSVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14569 - protein, 249 aa, Artificial Sequence
  Description of Artificial Sequence: Synthetic polypeptide
  Nanobody sequence
DVQLVESGGGLVQPGGSLRLSCAASGFTFDDYAIGWFRQAPGEEREGVSSISSTYGLTYYADPVKGRFTISSDNSKNTVYLQMNSLRPEDTAVYYCAATPIGLIGLDAYEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 14570 - protein, 158 aa, Artificial Sequence
  Description of Artificial Sequence: Synthetic polypeptide
  Nanobody sequence
EVQLVESGGGLVQAGGSLRLSCAASGFTFDDYAIGWFRQAPGEEREGVSSISSTYGLTYYADSVKGRFTISSSNAKNTVYLQMNNLKPEDTAVYYCAATPIERLGLDAYEYDYWGQGTLVTVSSAAADYKDHDGDYKDHDIDYKDDDDKGAAHHHHHH

SEQ ID NO: 14571 - protein, 250 aa, Artificial Sequence
  Description of Artificial Sequence: Synthetic polypeptide
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSGGGGSGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSA

SEQ ID NO: 14572 - protein, 120 aa, Artificial Sequence
  Description of Artificial Sequence: Synthetic polypeptide
  Rat-human chimeric polypeptide
QVQLVQSGAEVKKPGSSVKVSCKGSGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 14573 - protein, 120 aa, Artificial Sequence
  Description of Artificial Sequence: Synthetic polypeptide
  Rat-human chimeric polypeptide
QVQLVQSGAEVKKPGSSVKVSCKGSGFTFTDYKIHWVRQAPGQGLEWMGYFNPNSGYSTYNEKFKSRVTITADKSTSTAYMELSSLRSEDTAVYYCARLSPGGYYVMDAWGQGTTVTVSS

SEQ ID NO: 14574 - protein, 120 aa, Artificial Sequence
  Description of Artificial Sequence: Synthetic polypeptide
  Rat-human chimeric polypeptide
QVQLVQSGAEVKKPGASVKVSCKASGFTFTDYYMHWVRQAPGQGLEWMGWINPNSGYSTYAQKFQGRVTMTADTSISTAYMELSRLRSDDTAVYYCARLSPGGYYVMDAWGQGTTVTVSS

SEQ ID NO: 14575 - protein, 120 aa, Artificial Sequence
  Description of Artificial Sequence: Synthetic polypeptide
  Rat-human chimeric polypeptide
QVQLVQSGAEVKKPGASVKVSCKGSGFTFTDYKIHWVRQAPGQGLEWMGYFNPNSGYSTYAQKFQGRVTMTADTSISTAYMELSRLRSDDTAVYYCARLSPGGYYVMDAWGQGTTVTVSS

SEQ ID NO: 14576 - protein, 120 aa, Artificial Sequence
  Description of Artificial Sequence: Synthetic polypeptide
  Rat-human chimeric polypeptide
QVQLVQSGAEVKKPGASVKVSCKGSGFTFTDYKIHWVRQAPGQGLEWMGYFNPNSGYSTYNEKFKSRVTMTADTSISTAYMELSRLRSDDTAVYYCARLSPGGYYVMDAWGQGTTVTVSS

SEQ ID NO: 14577 - protein, 120 aa, Artificial Sequence
  Description of Artificial Sequence: Synthetic polypeptide
  Rat-human chimeric polypeptide
QVQLVQSGAEVKKPGSSVKVSCKGSGFTFTDYKISWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 14578 - protein, 120 aa, Artificial Sequence
  Description of Artificial Sequence: Synthetic polypeptide
  Rat-human chimeric polypeptide
QVQLVQSGAEVKKPGSSVKVSCKGSGFTFTDYKIHWVRQAPGQGLEWMGYFNPNSGYSNYAQKFQGRVTITADKSTSTAYMELSSLRSEDTAVYYCARLSPGGYYVMDAWGQGTTVTVSS

SEQ ID NO: 14579 - protein, 120 aa, Artificial Sequence
  Description of Artificial Sequence: Synthetic polypeptide
  Rat-human chimeric polypeptide
QVQLVQSGAEVKKPGSSVKVSCKGSGFTFTDYKIHWVRQAPGQGLEWMGYFNPNSGYATYAQKFQGRVTITADKSTSTAYMELSSLRSEDTAVYYCARLSPGGYYVMDAWGQGTTVTVSS

SEQ ID NO: 14580 - protein, 120 aa, Artificial Sequence
  Description of Artificial Sequence: Synthetic polypeptide
  Rat-human chimeric polypeptide
QVQLVQSGAEVKKPGASVKVSCKASGFTFTDYYMHWVRQAPGQGLEWMGWINPNSGYSTYSPSFQGQVTISADKSISTAYLQWSSLKASDTAMYYCARLSPGGYYVMDAWGQGTTVTVSS

SEQ ID NO: 14581 - protein, 120 aa, Artificial Sequence
  Description of Artificial Sequence: Synthetic polypeptide
  Rat-human chimeric polypeptide
QVQLVQSGAEVKKPGASVKVSCKASGFTFTDYYMHWVRQAPGQGLEWMGWINPNSGYSTYNEKFQGQVTISADKSISTAYLQWSSLKASDTAMYYCARLSPGGYYVMDAWGQGTTVTVSS

SEQ ID NO: 14582 - protein, 120 aa, Artificial Sequence
  Description of Artificial Sequence: Synthetic polypeptide
  Rat-human chimeric polypeptide
QVQLVQSGAEVKKPGASVKVSCKASGYTFTDYYMHWVRQAPGQGLEWMGWINPNSGYSTYSPSFQGQVTISADKSISTAYLQWSSLKASDTAMYYCARLSPGGYYVMDAWGQGTTVTVSS

SEQ ID NO: 14583 - protein, 120 aa, Artificial Sequence
  Description of Artificial Sequence: Synthetic polypeptide
  Rat-human chimeric polypeptide
QVQLVQSGAEVKKPGASVKVSCKASGYTFTDYYMHWVRQAPGQGLEWMGWINPNSGYSTYNEKFQGQVTISADKSISTAYLQWSSLKASDTAMYYCARLSPGGYYVMDAWGQGTTVTVSS

SEQ ID NO: 14584 - protein, 120 aa, Artificial Sequence
  Description of Artificial Sequence: Synthetic polypeptide
  Rat-human chimeric polypeptide
QMQLVQSGPEVKKPGTSVKVSCKASGFTFTDYYMHWVRQAPGQGLEWMGWINPNSGYSTYSPSFQGQVTISADKSISTAYLQWSSLKASDTAMYYCARLSPGGYYVMDAWGQGTTVTVSS

SEQ ID NO: 14585 - protein, 120 aa, Artificial Sequence
  Description of Artificial Sequence: Synthetic polypeptide
  Rat-human chimeric polypeptide
QMQLVQSGPEVKKPGTSVKVSCKASGFTFTDYYMHWVRQAPGQGLEWMGWINPNSGYSTYNEKFQGQVTISADKSISTAYLQWSSLKASDTAMYYCARLSPGGYYVMDAWGQGTTVTVSS

SEQ ID NO: 14586 - protein, 120 aa, Artificial Sequence
  Description of Artificial Sequence: Synthetic polypeptide
  Rat-human chimeric polypeptide
QMQLVQSGPEVKKPGTSVKVSCKASGFTFTDYKIHWVRQARGQRLEWIGWINPNSGYSTYNEKFQGQVTISADKSISTAYLQWSSLKASDTAMYYCARLSPGGYYVMDAWGQGTTVTVSS

SEQ ID NO: 14587 - protein, 120 aa, Artificial Sequence
  Description of Artificial Sequence: Synthetic polypeptide
  Rat-human chimeric polypeptide
QMQLVQSGPEVKKPGTSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 14588 - protein, 120 aa, Artificial Sequence
  Description of Artificial Sequence: Synthetic polypeptide
  Rat-human chimeric polypeptide
EVQLVQSGAEVKKPGESLKISCKGSGYSFTDYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 14589 - protein, 19 aa, Homo sapiens
MDWTWRILFLVAAATGAHS

SEQ ID NO: 14590 - protein, 120 aa, Artificial Sequence
  Description of Artificial Sequence: Synthetic polypeptide
  Rat-human chimeric polypeptide
EVQLVQSGAEVKKPGESLKISCKGSGYSFTDYKIHWVRQMPGKGLEWMGYFNPNSGYSTYSPSFQGQVTISADKSISTAYLQWSSLKASDTAMYYCARLSPGGYYVMDAWGQGTTVTVSS

SEQ ID NO: 14591 - protein, 108 aa, Artificial Sequence
  Description of Artificial Sequence: Synthetic polypeptide
  Chimeric rat-human sequence (I-KC3)
DIQMTQSPSSLSASVGDRVTITCRASQGINNYLGWYQQKPGKAPKRLIYNTNNLQTGVPSRFSGSGSGTEFTLTISSLQPEDFATYYCLQHNSFPTFGQGTKLEIKRT

SEQ ID NO: 14592 - protein, 621 aa, Macaca fascicularis
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSEFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDTLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSSQKTKIISNRGENSCKATGQVCHALCSPEGCWGPEPRDCVSCQNVSRGRECVDKCNILEGEPREFVENSECIQCHPECLPQVMNITCTGRGPDNCIQCAHYIDGPHCVKTCPAGVMGENNTLVWKYADAGHVCHLCHPNCTYGCTGPGLEGCARNGPKIPS

SEQ ID NO: 14593 - protein, 62 aa, Artificial Sequence
  Description of Artificial Sequence: Synthetic polypeptide
VVNGIPTRTNIGWMVSLRYRNKHICGGSLIKESWVLTARQCFPSRDLKDYEAWLGIHDVHGR

SEQ ID NO: 14594 - protein, 59 aa, Artificial Sequence
  Description of Artificial Sequence: Synthetic polypeptide
GIPTRTNIGWMVSLRYRNKHICGGSLIKESWVLTARQCFPSRDLKDYEAWLGIHDVHGR

SEQ ID NO: 14595 - protein, 1210 aa, Macaca fascicularis
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSEFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDTLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSSQKTKIISNRGENSCKATGQVCHALCSPEGCWGPEPRDCVSCQNVSRGRECVDKCNILEGEPREFVENSECIQCHPECLPQVMNITCTGRGPDNCIQCAHYIDGPHCVKTCPAGVMGENNTLVWKYADAGHVCHLCHPNCTYGCTGPGLEGCARNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCSIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 14596 - protein, 291 aa, Artificial Sequence
  Description of Artificial Sequence: Synthetic polypeptide
  synthetic antibody
MKYLLPTAAAGLLLLAAQPAMAQVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSSGGGGSGGGGSGGGGSQSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVLGAAAEQKLISEEDLNGAAHHHHHH

SEQ ID NO: 14597 - protein, 291 aa, Artificial Sequence; identical to SEQ ID NO: 14596
  Description of Artificial Sequence: Synthetic polypeptide
  synthetic antibody

SEQ ID NO: 14598 - protein, 288 aa, Artificial Sequence
  Description of Artificial Sequence: Synthetic polypeptide
  synthetic antibody
MKYLLPTAAAGLLLLAAQPAMAQVQLQQSGGGLVKPGGSLRLSCAASGFTFSSYSMNWVRQVPGKGLEWVSSISSSSSYIYYADSVKGRFTISRDNAKNSLYLQMNSLRDEDTAVYYCARDDGPPIQHWGQGTLVTVSSRGGGSGGGGSGGGGSQSVLSQPPSVSGAPGQRVTISCTGSSSNIGASFDVQWYQQLPGTAPKLLIYGNNNRPSGVPDRFSASKSGTSASLGITGLQIGDEADYYCGSYTGTYSWVFGGGTKVTVLGAAAEQKLISEEDLNGAAHHHHHH

SEQ ID NO: 14599 - protein, 290 aa, Artificial Sequence
  Description of Artificial Sequence: Synthetic polypeptide
  synthetic antibody
MKYLLPTAAAGLLLLAAQPAMAQVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLGAAAEQKLISEEDLNGAAHHHHHH

SEQ ID NO: 14600 - protein, 287 aa, Artificial Sequence
  Description of Artificial Sequence: Synthetic polypeptide
  synthetic antibody
MKYLLPTAAAGLLLLAAQPAMAQVQLVESGGGVVQPGRSLRLSCAASGFTFSDYYIHWVRQAPGKGLEWMAVISYDGNNKYYAASVKDRFTISRDNSKNTVSLQMNSLRAEDTAVYYCARDLYGDYALDYWGQGTLVTVSSGGGGSGGGGSGGGGSDIQMTQSPSTLSASLGDRVTITCRASQSIGSWLAWYQQKPGKAPKLLIYKASTLESGVPSRFTGSGSGTEFTLTISGLQPEDFATYYCQKLSSYPLTFGGGTKVEIKRAAAEQKLISEEDLNGAAHHHHHH

SEQ ID NO: 14601 - protein, 291 aa, Artificial Sequence
  Description of Artificial Sequence: Synthetic polypeptide
  synthetic antibody
MKYLLPTAAAGLLLLAAQPAMAQVQLVQSGGGLVQPGRSLRLSCAASGFTFDDYAMHWVRQAPGKGLEWVSGISWNSGSIGYADSVKGRFTISRDNAKNSLYLQMNSLRPEDTAVYYCARDLGAKQWLEGFDYWGQGTLVTVSSGGGGSGGGGSGGGGSNFMLTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLGAAAEQKLISEEDLNGAAHHHHHH

SEQ ID NO: 14602 - protein, 295 aa, Artificial Sequence
  Description of Artificial Sequence: Synthetic polypeptide
  synthetic antibody
MKYLLPTAAAGLLLLAAQPAMAEVQLVQSGAEVKKPGSSVKVSCKASGGTFSSYAISWVRQAPGQGLEWMGGIIPIFGTANYAQKFQGRVTITADESTSTAYMEVSSLRSEDTAVYYCAREEGPYCSSTSCYGAFDIWGQGTLVTVSSGGGGSGGGGSGGGGSQSVLTQDPAVSVALGQTVKITCQGDSLRSYFASWYQQKPGQAPTLVMYARNDRPAGVPDRFSGSKSGTSASLAISGLQSEDEADYYCAAWDDSLNGYLFGAGTKLTVLGAAAEQKLISEEDLNGAAHHHHHH

SEQ ID NO: 14603 - protein, 286 aa, Artificial Sequence
  Description of Artificial Sequence: Synthetic polypeptide
  synthetic antibody
MKYLLPTAAAGLLLLAAQPAMAQVQLQESGPGLVKPSETLSLTCTVSGGSFRSYYWSWIRPPGKGLEWIGYIFYSGSTNYNPSLKSRVTISVDTSKNQFSLKLSSLTAADTAVYYCARGHLGELGWFDPWGQGTLVTVSSSGGGSGGGGSGGGGSDIQMTQSPSSLSASVGDRVTITCQASQDISNYLNWYQQKPGKAPKLLIFAASRLASGVPSRFSGSGSGTDFSLTISSLQPDDFATYYCLQDSDYPLTFGGGTKVEIKRAAAEQKLISEEDLNGAAHHHHHH

SEQ ID NO: 14604 - protein, 291 aa, Artificial Sequence
  Description of Artificial Sequence: Synthetic polypeptide
  synthetic antibody
MKYLLPTAAAGLLLLAAQPAMAQVQLLQFGGGLVQPGGSLRLSCAASGFTFSSYAMSWVRQAPGKGLEWLSAISGSGGSTYYADSVKGRFTISRDNSKNTLYLQMNSLRAEDTAVYYCAREGYSSNWNNWYFDLWGRGTLVTVSSGGGGSGGGGSGGGGSDVVMTQSPSSLSASVGDRVTITCRASQSISSYLNWYQQKPGKAPELLIYAASRLQSGVPSRFSGSGSGTEFTLTISSLQPDDFATYYGQQYYNYPWTFGRGTKVEIKRAAAEQKLISEEDLNGAAHHHHHH

SEQ ID NO: 14605 - protein, 291 aa, Artificial Sequence
  Description of Artificial Sequence: Synthetic polypeptide
  synthetic antibody
MKYLLPTAAAGLLLLAAQPAMAQVQLQESGGGMVQPGRSLRLSCAASGFTFSSYAMSWVRQAPGKGLEWVSAISGSGGSTYYADSVKGRFTISRDNSKNTLYLQMNSLRAEDTALYYCAREGYSSNWNNWYFDLWGRGTLVTVSSGGGGSGGGGSGGGGSEIVLTQSPSSLSASVGDRVTITCRASQSISSYLNWYQQKPGKAPKLLIYAASSLQSGVPSRFSGSGSGTDFTLTISSLQPDDFATYYCQQYNSYPWTFGQGTKLEIKRAAAEQKLISEEDLNGAAHHHHHH

SEQ ID NO: 14606 - protein, 243 aa, Artificial Sequence
  Description of Artificial Sequence: Synthetic polypeptide
  synthetic antibody
MAQVQLVESGGGVVQPGRSLRLSCAASGFTFSSYGMHWVRQAPGKGLEWVAVISYDGSNKYYADSVKGRFTISRDNSKNTLYLQMNSLRAEDTAEYYCAKYPLNWGQGTLVTVSSGGGGSGGGGSGGGGSQSALTQPASVSGSPGQSITISCTGTSSDVGGYNYASWYQQHPGKAPKLMIYEVSNRPSGVFNRFSGAKSGNTASLTISGLQAEDEADYYCNSYTSSSTWVFGGGTKLTVLGNS

SEQ ID NO: 14607 - protein, 295 aa, Artificial Sequence
  Description of Artificial Sequence: Synthetic polypeptide
  synthetic antibody
MAQVQLQESGGGVVQPGRSLRLSCAASGFTFKSYGMHWVRQAPGKGLEWVSAISASGGSTYYADSVKGRFTIFRDNSENSLYLQMNSLRAEDTAVYYCARDSSGSFDYWGQGTLVTVSSGGGGSGGGGSGGGGSDIVMTQSPSTLSASIGDRVTITCRASEGIYHWLAWYQQKPGKAPKLLIYKASSLASGAPSRFSGSGSGTDTITCRASEGIYHWLAWYQQKPGKAPKLLIYKASSLASGAPSRFSGSGSGTDFTLTISSLQAEDVAVYYCQQYYRSPLTFGGGTKLENKRNS

SEQ ID NO: 14608 - protein, 304 aa, Homo sapiens [sequence omitted]

SEQ ID NO: 14609 - protein, 250 aa, Unknown
  Description of Unknown: GFP variant sequence
MGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKRKNGIKANFKIRHNVKDGSVQLADHYQQNTPIGRGPVLLPRNHYLSTRSALSKDPKEKRDHMVLLEFVTAAGITHGMDELYKGHGHHHHHH

SEQ ID NO: 14610 - protein, 250 aa, Unknown
  Description of Unknown: GFP variant sequence
MGSASKGERLFTGVVPILVELDGDVNGHKFSVRGKGKGDATRGKLTLKFICITGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGHHHHHH

SEQ ID NO: 14611 - protein, 250 aa, Artificial Sequence
  Description of Artificial Sequence: Synthetic polypeptide
MGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGHHHHHH

SEQ ID NO: 14612 - protein, 250 aa, Unknown
  Description of Unknown: GFP variant sequence
MGSASKGERLFRGKVPILVELKGDVNGHKFSVRGKGKGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGHHHHHH

SEQ ID NO: 14613 - protein, 250 aa, Artificial Sequence
  Description of Artificial Sequence: Synthetic polypeptide
MGSASKGEELFTGVVPILVELDGDVNGHKFSVRGEGEGDATNGKLTLKFICTTGKLPVPWPTLVTTLTYGVQCFSRYPDHMKRHDFFKSAMPKGYVQERTISFKKDGKYKTRAEVKFEGRTLVNRIKLKGRDFKEKGNILGHKLRYNFNSHKVYITADKQKNGIKANFKIRHNVEDGSVQLADHYQQNTPIGDGPVLLPDNHYLSTQSALSKDPNEKRDHMVLLEFVTAAGITHGMDELYKGHGHHHHHH

SEQ ID NO: 14614 - protein, 250 aa, Unknown
  Description of Unknown: GFP variant sequence
MGSASKGERLFTGVVPILVELDGDVNGHKFSVRGEGEGDATRGKLTLKFICTTGKLPVPWPTINTTLTYGVQCFSRYPKHMKRHDFFKSAMPKGYVQERTISFKKDGIYKTRAEVKFEGRTLVNRIKLKGRDFKEKGNILGHKLRYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGHHHHHH

SEQ ID NO: 14615 - protein, 250 aa, Unknown
  Description of Unknown: GFP variant sequence
MGSASKGERLFTGVVPILVELDGDVNGHKFSVRGEGEGDATRGKLTLKFICTTGKLPVPWPTINTTLTYGVQCFSRYPKHMKQHDFFKSAMPEGYVQERTISFKDDGTYKTRAEVKFEGDTINNRIELKGIDFKEDGNILGHKLEYNFNSHNVYITADKRKNGIKAKFKIRHNVKDGSVQLADHYQQNTPIGRGPVLLPRNHYLSTRSKLSKDPKEKRDHMVLLEFVTAAGIKHGRDERYKGHGHHHHHH

SEQ ID NO: 14616 - protein, 250 aa, Unknown
  Description of Unknown: GFP variant sequence
MGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKRKNGIKAKFKIRHNVKDGSVQLAKHYQQNTPIGRGPVLLPRKHYLSTRSKLSKDPKEKRDHMVLLEFVTAAGIKHGRKERYKGHGHHHHHH

SEQ ID NO: 14617 - protein, 250 aa, Unknown
  Description of Unknown: GFP variant sequence
MGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRILVNRIELKGRDFKEKGNILGHKLEYNFNSHNVYITADKRKNGIKANFKIRHNVKDGSVQLADHYQQNTPIGRGPVLLPRNHYLSTRSALSKDPKEKRDHMVLLEFVTAAGITHGMDELYKGHGHHHHHH

SEQ ID NO: 14618 - protein, 250 aa, Unknown
  Description of Unknown: GFP variant sequence
MGSASKGEELFTGVVPILVELDGDVNGHKFSVRGEGEGDATNGKLTLKFICTTGKLPVPWPTLNTTLTYGVQCFSRYPDHMKQHDFFKSAMPEGYVQERTISFKDDGTYKTRAEVKFEGDTLVNRIELKGIDFKEDGNILGEKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGHHHHHH

SEQ ID NO: 14619 - protein, 268 aa, Unknown
  Description of Unknown: single-chain Fv antibody fused to His tag sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKLPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHG

SEQ ID NO: 14620 - protein, 267 aa, Unknown
  Description of Unknown: single-chain Fv antibody fused to His tag sequence
MGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14621 - protein, 539 aa, Unknown
  Description of Unknown: Fusion protein- GFP+ C6.5 sequence
MGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14622 - protein, 539 aa, Artificial Sequence
  Description of Artificial Sequence: Synthetic polypeptide
MGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKRKNGIKANFKIRHNVKDGSVQLADHYQQNTPIGRGPVLLPRNHYLSTRSALSKDPKEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14623 - protein, 539 aa, Unknown
  Description of Unknown: Fusion protein- GFP+ C6.7 sequence
MGSQVQLLQSGAELKKPGESLKISCKGSGYSFTSYWIAWVRQMPGKGLEYMGLIYPGDSDTKYSPSEQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRENVEDGSVQLADHYQQNTPIGDGPVLLPDNHYLSTQSALSKDPNEKRDHMVLLEFVTAAGITHGMDELYKGHGHHHHHH

SEQ ID NO: 14624 - protein, 539 aa, Unknown
  Description of Unknown: Fusion protein- GFP+ C6.8 sequence
MGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKRKNGIKANFKIRHNVKDGSVQLADHYQQNTPIGRGPVLLPRNHYLSTRSALSKDPKEKRDHMVLLEFVTAAGITHGMDELYKGHGHHHHHH

SEQ ID NO: 14625 - protein, 539 aa, Unknown
  Description of Unknown: Fusion protein- GFP+ C6.9 sequence
MGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKRKNGIKANFKIRHNVKDGSVQLADHYQQNTPIGRGPVLLPRNHYLSTRSALSKDPKEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14626 - protein, 539 aa, Unknown
  Description of Unknown: Fusion protein- GFP+ C6.10 sequence
MGSASKGERLFTGVVPILVELDGDVNGHKFSVRGKGKGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14627 - protein, 539 aa, Unknown
  Description of Unknown: Fusion protein- GFP+ C6.11 sequence
MGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14628 - protein, 539 aa, Unknown
  Description of Unknown: Fusion protein- GFP+ C6.5 sequence
MGSASKGERLFRGKVPILVELKGDVNGHKFSVRGKGKGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14629 - protein, 539 aa, Unknown
  Description of Unknown: Fusion protein- GFP+ C6.6 sequence
MGSASKGEELFTGVVPILVELDGDVNGHKFSVRGEGEGDATNGKLTLKFICTTGKLPVPWPTLVTTLTYGVQCFSRYPDHMKRHDFFKSAMPKGYVQERTISFKKDGKYKTRAEVKFEGRTLVNRIKLKGRDFKEKGNILGHKLRYNFNSHKVYITADKQKNGIKANFKIRHNVEDGSVQLADHYQQNTPIGDGPVLLPDNHYLSTQSALSKDPNEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14630 - protein, 539 aa, Unknown
  Description of Unknown: Fusion protein- GFP+ C6.7 sequence
MGSASKGERLFTGVVPILVELDGDVNGHKISVRGEGEGDATRGKLTLKFICTTGKLPVPWPTINTFLTYGVQCFSRYPKHMKRHDFFKSAMPKGYVQERTISFKKDGTYKTRAEVKFEGRTINNRIKLKGRDFKEKGNILGHKLRYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14631 - protein, 539 aa, Unknown
  Description of Unknown: Fusion protein- GFP+ C6.8 sequence
MGSASKGERLFTGVVPILVELDGDVNGHKFSVRGEGEGDATRGKLTLKFICTTGKLPVPWPTLVTTLTYGVQCFSRYPKHMKQHDFFKSAMPEGYVQERTISFKDDGTYKTRAEVKFEGDTINNRIELKGIDFKEDGNILGHKLEYNFNSHNVYITADKRKNGIKAKFKIRHNVKDGSVQLADHYQQNTPIGRGPVLLPRNHYLSTRSKLSKDPKEKRDHMVLLEFVTAAGIKHGRDERYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14632 - protein, 539 aa, Artificial Sequence
  Description of Artificial Sequence: Synthetic polypeptide
MGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKRKNGIKAKFKIRHNVKDGSVQLAKHYQQNTPIGRGPVLLPRKHYLSTRSKLSKDPKEKRDHMVLLEFVTAAGIKHGRKERYKGHGSSSSGSSSSGSSSSGSSSSGSSSSGSSSSGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGHHHHHH

SEQ ID NO: 14633 - protein, 542 aa, Unknown
  Description of Unknown: Fusion protein- GFP+ C6.10 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGDSK

SEQ ID NO: 14634 - protein, 542 aa, Unknown
  Description of Unknown: Fusion protein- GFP+ C6.11 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFRGKVPILVELKGDVNGHKFSVRGKGKGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGDSK

SEQ ID NO: 14635 - protein, 542 aa, Unknown
  Description of Unknown: Fusion protein- GFP+ C6.12 sequence
MHHHHHHGSQVQLLQSGAELKKPGESLKISCKGSGYSFTSYWIAWVRQMPGKGLEYMGLIYPGDSDTKYSTSFQGQVTISVDKSVSTAYLQWSSLKPSDSAVYFCARHDVGYCSSSNCAKWPEYFQHWGQGTLVTVSSGGGGSGGGGSGGGGSQSVLTQFPSVSAAPGQKVTISCSGSSSNIGNNYVSWYQQLPGTAPKLLIYGHTNRPAGVPDRFSGSKSGTSASLAISGERSEDEADYYCAAWDDSLSGWVEGGGTKLTVLGGHGSSSSGSSSSGSSSSGSSSSGSSSSGSSSSGSASKGEELFTGVVPILVELDGDVNGHKFSVRGEGEGDATNGKLTLKFICTTGKLPVPWPTLVTTLTYGVQCFSRYPDHMKRHDFFKSAMPKGYVQERTISFKKDGKYKTRAEVKFEGRTLVNRIKLKGRDFKEKGNILGHKLRYNFNSHKVYITADKQKNGIKANFKIRHNVEDGSVQLADHYQQNTPIGDGPVLLPDNHYLSTQSALSKDPNEKRDHMVLLEFVTAAGITHGMDELYKGHGDSK

SEQ ID NO: 14636 - protein, 542 aa, Artificial Sequence
  Description of Artificial Sequence: Synthetic polypeptide
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPKGYVQERTISFKKDGTYKTRAEVKFEGRTLVNRIKLKGRDFKEKGNILGHKLRYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGDSK

SEQ ID NO: 14637 - protein, 542 aa, Artificial Sequence
  Description of Artificial Sequence: Synthetic polypeptide
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKRKNGIKAKFKIRHNVKDGSVQLADHYQQNTPIGRGPVLLPRNHYLSTRSKLSKDPKEKRDHMVLLEFVTAAGIKHGRDERYKGHGDSK

SEQ ID NO: 14638 - protein, 542 aa, Unknown
  Description of Unknown: Fusion protein- GFP+ C6.5 sequence
  MOD_RES (28)..(28): Any amino acid
MHHHHHHGSQVQLLQSGAELKKPGESIXISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTINTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGIKLTVLGGHGSSSSGSSSSGSSSSGSSSSGSSSSGSSSSGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKRKNGIKAKFKIRHNVKDGSVQLAKHYQQNTPIGRGPVLLPRKHYLSTRSKLSKDPKEKRDHMVLLEFVTAAGIKHGRKERYKGHGDSK

SEQ ID NO: 14639 - protein, 542 aa, Unknown
  Description of Unknown: Fusion protein- GFP+ C6.6 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKRKNGIKANFKIRHNVKDGSVQLADHYQQNTFIGRGPVLLPRNHYLSTRSALSKDPKEKRDHMVLLEFVTAAGITHGMDELYKGHGDSK

SEQ ID NO: 14640 - protein, 542 aa, Unknown
  Description of Unknown: Fusion protein- GFP+ C6.7 sequence
MHHHHHHGSQVQLLQSGAELKKPGESLKISCKGSGYSFTSYWIAWVRQMPGKGLEYMGLEYPGDSDTKYSPSFQGQVTISVDKSVSTAYLQWSSLKRSDSAVYFCAREDVGYCSSSNCAKWPEYFQHWGQGTLNTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSISGNVWCGGTKLTVLGGHGSSSSGSSSSGSSSSGSSSSGSSSSGSSSSGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGDSK

SEQ ID NO: 14641 - protein, 549 aa, Artificial Sequence
  Description of Artificial Sequence: Synthetic polypeptide
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGEQKLISEEDL

SEQ ID NO: 14642 - protein, 549 aa, Artificial Sequence
  Description of Artificial Sequence: Synthetic polypeptide
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFRGKVPILVELKGDVNGHKFSVRGKGKGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGEQKLISEEDL

SEQ ID NO: 14643 - protein, 549 aa, Artificial Sequence
  Description of Artificial Sequence: Synthetic polypeptide
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGEELFTGVVPILVELDGDVNGHKFSVRGEGEGDATNGKLTLKFICTTGKLPVPWPTLVTTLTYGVQCFSRYPDHMKRHDFFKSAMPKGYVQERTISFKKDGKYKTRAEVKFEGRTLVNRIKLKGRDFKEKGNILGHKLRYNFNSHKVYITADKQKNGIKANFKIRHNVEDGSVQLADHYQQNTPIGDGPVLLPDNHYLSTQSALSKDPNEKRDHMVLLEFVTAAGITHGMDELYKGHGEQKLISEEDL

SEQ ID NO: 14644 - protein, 549 aa, Artificial Sequence
  Description of Artificial Sequence: Synthetic polypeptide
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPKGYVQERTISFKKDGTYKTRAEVKFEGRTLVNRIKLKGRDFKEKGNILGHKLRYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGEQKLISEEDL

SEQ ID NO: 14645 - protein, 549 aa, Unknown
  Description of Unknown: Fusion protein- GFP+ C6.12 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKQHDFFKSAMPEGYVQERTISFKDDGTYKTRAEVKFEGDTLVNRIELKGIDFKEDGNILGHKLEYNFNSHNVYITADKRKNGIKAKFKIRHNVKDGSVQLADHYQQNTPIGRGPVLLPRNHYLSTRSKLSKDPKEKRDHMVLLEFVTAAGIKHGRDERYKGHGEQKLISEEDL

SEQ ID NO: 14646 - protein, 549 aa, Unknown
  Description of Unknown: Fusion protein- GFP+ C6.13 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTINTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYTTADKRKNGIKAKFKIRHNVKDGSVQLAKHYQQNTPIGRGPVLLPRKHYLSTRSKLSKDPKEKRDHMVLLEFVTAAGIKHGRKERYKGHGEQKLISEEDL

SEQ ID NO: 14647 - protein, 549 aa, Unknown
  Description of Unknown: Fusion protein- GFP+ C6.14 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGERLFTGVVPILVELDGDVNGHKFSVRGEGEGDATRGKLTLKFICTTGKLPVPWPTLVTTLTYGVQCFSRYPKHMKRHDFFKSAMPEGYVQERTISFKKDGTYKTRAEVKFEGRTLVNRIELKGRDFKEKGNILGHKLEYNFNSHNVYITADKRKNGIKANFKIRHNVKDGSVQLADHYQQNTPIGRGPVLLPRNHYLSTRSALSKDPKEKRDHMVLLEFVTAAGITHGMDELYKGHGEQKLISEEDL

SEQ ID NO: 14648 - protein, 549 aa, Unknown
  Description of Unknown: Fusion protein- GFP+ C6.14 sequence
MHHHHHHGSQVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSSGGGGSGGGGSGGGGSQSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVLGGHGSSSSGSSSSGSSSSGSSSSGSSSSGSSSSGSASKGEELFTGVVPIIVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYKGHGEQKLISEEDL

SEQ ID NO: 14649 - protein, 260 aa, Unknown
  Description of Unknown: Tagged GFP sequence
MEQKLISEEDLGSASKGERLFRGKVPILVELKGDVNGHKFSVRGKGKGDATRGKLTLKFICTTGKLPVPWPTLVTTLTYGVQCFSRYPKHMKRHDFFKSAMPKGYVQERTISFKKDGKYKTRAEVKFEGRTLVNRIKLKGRDFKEKGNILGHKLRYNFNSHKVYITADKRKNGIKAKFKIRHNVKDGSVQLADHYQQNTPIGRGPVLLPRNHYLSTRSKLSKDPKEKRDHMVLLEFVTAAGIKHGRDERYKGHGHHHHHH

SEQ ID NO: 14650 - protein, 250 aa, Unknown
  Description of Unknown: Tagged GFP sequence
MGSASKGERLFRGKVPILVELKGDVNGHKFSVRGKGKGDATRGKLTLKFICTTGKLPVPWPTLVTTLTYGVQCFSRYPKHMKRHDFFKSAMPKGYVQERTISFKKDGKYKTRAEVKFEGRTLVNRIKLKGRDFKEKGNILGHKLRYNFNSHKVYITADKRKNGIKAKFKIRHNVKDGSVQLADHYQQNTPIGRGPVLLPRNHYLSTRSKLSKDPKEKRDHMVLLEFVTAAGIKHGRDERYKGHGHHHHHH

SEQ ID NO: 14651 - protein, 246 aa, Artificial Sequence
  Description of Artificial Sequence: Synthetic polypeptide
  A12 ScFv sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKSSSSWYRSYYFDYWGQGTLVTVSSGGGGGSGGGGSGGGGSQSALTQDPAVSVALGQTVRITCRGDSLRNYYASWYQQKPGQAPVLVIYGKNNRPSGIPDRFSGSFSGNTASLTITGAQAEDEADYYCNSRDSSANQMFGGGTKVTVLG

SEQ ID NO: 14652 - protein, 245 aa, Artificial Sequence
  Description of Artificial Sequence: Synthetic polypeptide
  C2 ScFv sequence
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCASQHVGEQSRYFDYWGQGTLVTVSSGGGGGSGGGGSGGGGSDIVMTQSPSSLSASIGDRVTITCRASHSISSYVNWYQKKPGKAPNLLIYAASYLPRGVPSRFSGSGLGTDFTLTISNLQPEDFATYYCQESYSTPYSFGQGTKVDIKR

SEQ ID NO: 14653 - protein, 241 aa, Artificial Sequence
  Description of Artificial Sequence: Synthetic polypeptide
  E9 ScFv sequence
QVQLQESGGGVVQPGRSLRLSCAASGFTFSSYGMHWVRQAPGKGLEWVSAIGSSGGSTHDADTVKGRFTISRDNAKNSLYLQMNSLRAEDTAVYYCARDRARGFDYWGQGTLVTVSSGGGGGSGGGGSGGGGSEIVLTQSPSTLSASIGDRVTITCRASQGISSYLAWYQQKPGKAPKLLIYGASSLQSGVPSRFSGRGSGADFTLTISSLQPEDFATYYCQQLISYPLTFGGGTKVEIKR

SEQ ID NO: 14654 - protein, 241 aa, Artificial Sequence
  Description of Artificial Sequence: Synthetic polypeptide
  F1 ScFv sequence
QVQLVQSGAEVKKPGASVKVSCKASGYTFTDYYMHWVRQAPGEGLEWMGWMNPNSGGTNYAQKFQGRVTMTRDTSISTAYMELSRLRSDDTAVYYCARSHYWDSWSPGTLVTVSSGGGGGSGGGGSGGGGSSALTQPASVSGSPGQSITISCTGTSGDVGGYNYVSWYQQHPGKAPKLMIYDVSNRPSGVSNRFSGSKSGNTASLTISGLQAEDEADYYCTSYAGSRNLVFGGGTKLTVLG

SEQ ID NO: 14655 - protein, 243 aa, Artificial Sequence
  Description of Artificial Sequence: Synthetic polypeptide
  F11 ScFv sequence
QVQLQESGGGLLQPGGSLRLSCAASRFTFSNYAMSWVRQAPGKGLEWVSAISGSGASTYYADSVKGRFTISRDNSKNTLYLQMNSLRAEDTAVYYCSNLYGDYDYWGQGTLVTVSSGGGGGSGGGGSGGGGSQSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVLG

SEQ ID NO: 14656 - protein, 255 aa, Artificial Sequence
  Description of Artificial Sequence: Synthetic polypeptide
  G1 ScFv sequence
QVQLQESGGGVVQPGGSLRLSCAASGFTFSSYSMNWVRQAPGKGLEWVSSISSSSSYIYYADSVKGRFTISRDNAKNSLYLQMNSLRAEDTAVYYCARDLPSDDYGDYDYYYYGMDVWGQGTTVTVSSGGGGGSGGGGSGGGGSQSVLTQPPSASGTPGQRVTLFCSGSSSNIASNSVKWYQQPPQRAPKLLMFSDDQRPSGVPVRFSASKSGTSASLAISGLQSEDEADYYCAAWDDSLNAEVFGGGTKVTVLG

SEQ ID NO: 14657 - protein, 244 aa, Artificial Sequence
  Description of Artificial Sequence: Synthetic polypeptide
  H2 ScFv sequence
EVQLVESGGGLVQPGGSLRLSCAASGFTFSTYAMSWVRQAPGKGLEWVSAISGSGGSTYYADSVKGRFTISRDNSKNTLYLQMNSLRAEDTAVYYCAREGGKWYYGMDVWGRGTLVTVSSGGGGGSGGGGSGGGGSSSELTQDPAVSVALGQTVRITCQGDSLRSYYTNWFQQKPGQAPLLVVYAKNKRPSGIPDRFSGSGSGDTASLTITGAQAEDEADYYCNSRDSSGNYLFAAGTKLTVLG

SEQ ID NO: 14658 - protein, 245 aa, Artificial Sequence
  Description of Artificial Sequence: Synthetic polypeptide
  H2 ScFv sequence
QVQLQESGGGLVQPGGSLRLSCAASGFTFSNYAMSWVRQAPGKGLEWVSAISGSGGSTYYADSVKGRFTISRDNSKNTLYLQMNSLRAEDTAVYYCAKDRFRAAAYWGQGTLVTVSSGGGGGSGGGGSGGGGSQSVLTQPPSVSAAPGQKVTISCTGSSSNIGAGYDVHWYQQLPGTAPKLLIYGNSNRPSGVPDRFSGSKSGTSASLAISGLQSEDEADYYCAAWDDILNGEIFGGGTKVTVLG

SEQ ID NO: 14659 - protein, 241 aa, Homo sapiens
ELQMTQSPSLLSASTGDRVTISCRASQSISSYLNWYQQKPGKAPKLLIYTRSSLQSGVPSRFSGSGSGTDFTLTISSLQPEDFATYYCQQSYSTPHTFGQGTKLEIKGGSSRSSSSGGGGSGGGGEVQLVESGGGVVQPGRSLRLSCAASGFTFSSYAMHWVRQAPGKGLEWVAVIWYDGSNRYYADSVKGRFTISRDNSKNTLYLQMNSLRAEDTAVYYCASQATEGLIWGQGTLVTVSP

SEQ ID NO: 14660 - protein, 330 aa, Artificial Sequence
  Description of Artificial Sequence: Synthetic polypeptide
  EGFR single chain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 14661 - protein, 415 aa, Artificial Sequence
  Description of Artificial Sequence: Synthetic polypeptide
  EGFR construct
MATGSRTSLLLAFGLLCLPWLQEGSAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 14662 - protein, 359 aa, Artificial Sequence
  Description of Artificial Sequence: Synthetic polypeptide
  IGF-1R single chain
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSGGGGSGGGGSGGGGSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 14663 - protein, 418 aa, Artificial Sequence
  Description of Artificial Sequence: Synthetic polypeptide
  IGF-1R single chain
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSGGGGSGGGGSGGGGSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 14664 - protein, 353 aa, Artificial Sequence
  Description of Artificial Sequence: Synthetic polypeptide
  EGFR single chain
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 14665 - protein, 363 aa, Artificial Sequence
  Description of Artificial Sequence: Synthetic polypeptide
  EGFR sinble chain
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCGFSASPAFFQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 14666 - protein, 412 aa, Artificial Sequence
  Description of Artificial Sequence: Synthetic polypeptide
  EGFR single chain
MATGSRTSLLLAFGLLCLPWLQEGSASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 14667 - protein, 620 aa, Artificial Sequence
  Description of Artificial Sequence: Synthetic polypeptide
  Fab12 scFvHL
MATGSRTSLLLAFGLLCLPWLQEGSAEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGGGSGGGGSGGGGSDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 14668 - protein, 658 aa, Artificial Sequence
  Description of Artificial Sequence: Synthetic polypeptide
  Fab12 scFvHL
MATGSRTSLLLAFGLLCLPWLQEGSAEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGGGSGGGGSGGGGSDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRSKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 14669 - protein, 616 aa, Artificial Sequence
  Description of Artificial Sequence: Synthetic polypeptide
  VEGF scFvLH
MATGSRTSLLLAFGLLCLPWLQEGSADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 14670 - protein, 126 aa, Artificial Sequence
  Description of Artificial Sequence: Synthetic polypeptide
  Variable chain of single chain antibody
EAQLVQSGAEGKKPGSSVKVSCKAPGGTFNSYAISWVRQAPGQGLEWMGGIIPIFGTAYYAQKFQGRVTITADESTSTAYMELSSLRSEDTAVYYCAREEGPYCSSTSCYGAFDIWGRGTLVTVSS

SEQ ID NO: 14671 - protein, 126 aa, Artificial Sequence; identical to SEQ ID NO: 12975
  Description of Artificial Sequence: Synthetic polypeptide
  Variable chain of single chain antibody

SEQ ID NO: 14672 - protein, 126 aa, Artificial Sequence; identical to SEQ ID NO: 12976
  Description of Artificial Sequence: Synthetic polypeptide
  Variable chain of single chain antibody

SEQ ID NO: 14673 - protein, 126 aa, Artificial Sequence
  Description of Artificial Sequence: Synthetic polypeptide
  Variable chain of single chain antibody
EVQLVQSGAEVKKLGSSVKVSCKASGGTFSSYAISWVRQAPGQGLEWVGGIIPIFGTANYAQKFQGRVKITADESASTAYMELSSLRSEDTAVYYCAREEGPYCSSTSCYGAFDIWGQGTLVTVSS

SEQ ID NO: 14674 - protein, 126 aa, Artificial Sequence
  Description of Artificial Sequence: Synthetic polypeptide
  Variable chain of single chain antibody
EVQLVQSGAEVKKPGSSVKVSCKASGGTFSSYAISWVRQAPGQGLEWVGGIIPIFGTANYAQKFQGRVKITADESASTAYMELSSLRSEDTAVYYCAREEGPYCSSTSCYGAFDIWGQGTLVTVSS

SEQ ID NO: 14675 - protein, 108 aa, Artificial Sequence
  Description of Artificial Sequence: Synthetic polypeptide
  Variable chain of single chain antibody
QSVLTQDPAVSAALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 14676 - protein, 243 aa, Artificial Sequence
  Description of Artificial Sequence: Synthetic polypeptide
  Synthetic Polynucleotide used for CDR-H3 of anti-HER2 antibody
EVQLVESGGGLVQPGGSLRLSCAASGFTLSGDWIHWVRQAPGKCLEWVGEISAAGGYTDYADSVKGRFTISADTSKNTAYLQMNSLRAEDTAVYYCARESRVSFEAAMDYWGQGTLVTVSSGGGGSGGGGSGGGGSDIQMTQSPSSLSASVGDRVTITCRASQNIATDVAWYQQKPGKAPKLLIYSASFLYSGVPSRFSGSGSGTDFTLTISSLQPEDFATYYCQQSEPEPYTFGCGTKVEIK

SEQ ID NO: 14677 - protein, 248 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTGGGGSGGGGSGGGGSQSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVL

SEQ ID NO: 14678 - protein, 238 aa, Artificial Sequence
  Description of Artificial Sequence: Synthetic polypeptide
  Synthetic construct
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIK

SEQ ID NO: 14679 - protein, 238 aa, Artificial Sequence
  Description of Artificial Sequence: Synthetic polypeptide
  Synthetic construct
QVQLVQSGAEVKKPGSSVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGCGTKVEIK

SEQ ID NO: 14680 - protein, 243 aa, Artificial Sequence
  Description of Artificial Sequence: Synthetic polypeptide
  Synthetic construct
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIK

SEQ ID NO: 14681 - protein, 248 aa, Artificial Sequence
  Description of Artificial Sequence: Synthetic polypeptide
  Synthetic construct
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIK

SEQ ID NO: 14682 - protein, 243 aa, Artificial Sequence
  Description of Artificial Sequence: Synthetic polypeptide
  Synthetic construct
QVQLVQSGAEVKKPGSSVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGCGTKVEIK

SEQ ID NO: 14683 - protein, 240 aa, Artificial Sequence
  Description of Artificial Sequence: Synthetic polypeptide
  Synthetic construct
DIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSS

SEQ ID NO: 14684 - protein, 240 aa, Artificial Sequence
  Description of Artificial Sequence: Synthetic polypeptide
  Synthetic construct
EVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSGGGGSGGGGSGGGGSDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIK

SEQ ID NO: 14685 - protein, 251 aa, Artificial Sequence
  Description of Artificial Sequence: Synthetic polypeptide
EVQLVQSGAEVKKPGESLTISCKGPGYNFFNYWIGWVRQMPGKGLEWMGIIYPTDSDTRYSPSFQGQVTISVDKSISTAYLQWSSLKASDTAMYYCARSIRYCPGGRCYSGYYGMDVWGQGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 14686 - protein, 245 aa, Artificial Sequence
  Description of Artificial Sequence: Synthetic polypeptide
  single chain fv 9A2
QVQLVQSGAEVRKPGASVKVSCKTSGYTFRNYDINWVRQAPGQGLEWMGRISGHYGNTDHAQKFQGRFTMTKDTSTSTAYMELRSLTFDDTAVYYCARSQWNVDYWGRGTLVTVSSGGGGSGGGGSGGGGSALNFMLTQPHSVSESPGKTVTISCTRSSGSIASNYVQWYQQRPGSSPTTVIFEDNRRPSGVPDRFSGSIDTSSNSASLTISGLKTEDEADYYCQSFDSTNLVVFGGGTKVTVLG

SEQ ID NO: 14687 - protein, 245 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCASSPYSSRWYSFDPWGQGTMVTVSSGGGGSGGGGSGGGGSALSYELTQPPSVSVSPGQTATITCSGDDLGNKYVSWYQQKPGQSPVLVIYQDTKRPSGIPERFSGSNSGNIATLTISGTQAVDEADYYCQVWDTGTVVFGGGTKLTVLG

SEQ ID NO: 14688 - protein, 251 aa, Artificial Sequence
  Description of Artificial Sequence: Synthetic polypeptide
EVQLVQSGAEVKKPGESLTISCKGSGYNFFNYWIGWVRQMPGKDLEWMGIIYPTDSDTRYSPSFQGQVTISVDKSISTAYLQWSSLKASDTAMYYCARSIRYCPGGRCYSGYYGMDVWGQGTMVTVSSGGGSSGGGGSGGGGSSELTQDPAVSVALGQTVRITCRGDSLRNYYASWYQQKPGQAPVLVIYGKNNRPSGIPDRFSGSSSGNTASLTITGAQAEDEADYYCNSRDSSGNHMVFGGGTKLTVLG

SEQ ID NO: 14689 - protein, 249 aa, Artificial Sequence
  Description of Artificial Sequence: Synthetic polypeptide
EVQLVESGGGVVQPGRSLRLSCAASGFTFSDFAMHWVRQIPGKGLEWLSGLRHDGSTAYYAGSVKGRFTISRDNSRNTVYLQMNSLRAEDTATYYCVTGSGSSGPHAFPVWGKGTLVTVSSGGGGSGGGGSGGGGSALSYVLTQPPSASGTPGQRVTISCSGSNSNIGTYTVNWFQQLPGTAPKLLIYSNNQRPSGVPDRFSGSKSGTSASLAISGLQSEDEADYYCAAWDDSLNGPVFGGGTKVTVLG

SEQ ID NO: 14690 - protein, 251 aa, Artificial Sequence
  Description of Artificial Sequence: Synthetic polypeptide
EVQLVQSGAEVKKPGESLTISCKGSGYNFFNYWIGWVRQMPGKGLEWMGIIYPTDSDTRYSPSFQGQVTISVDKSISTAYLQWSSLKASDTAMYYCARSIRYCPGGRCYSGYYGMDVWGQGTLVTVSSGGGGSGGGGSGGGGSSELTQDPAVSVALGQTVRITCQGDSLRSYYTNWFQQKPGQAPLLVVYAKNKRPSGIPDRFSGSSSGNTASLTITGAQAEDEADYYCNSRDSSGNHVVFGGGTKLTVLG

SEQ ID NO: 14691 - protein, 251 aa, Artificial Sequence
  Description of Artificial Sequence: Synthetic polypeptide
QVQLVQSGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRGSSGWFLNWFDPWGQGTLVTVSSLEGGGGSGGGGSGGGGSELETTLTQSPATLSLSPGERATLSCRASQSISSSYLAWYQHKPGQAPRLLIYGASRRATGIPDRFSGSGSGTDFSLTISRLEPEDFAVYYCLHYGSSKWTFGQGTKVEIKR

SEQ ID NO: 14692 - protein, 253 aa, Artificial Sequence
  Description of Artificial Sequence: Synthetic polypeptide
  Synthetic polypeptide for an anti-VEGF scFv
EVQLLESGGGLVQPGGSLRLSCAASGFTFSGYAMSWVRQAPGKGLEWVSSIYSSSGSKYYADSVKGRFTISRDNSKNTLYLQMNSLRAEDTAVYYCARASSTCTRTWCSYDDAMDVWGQGTLVTVSSGGGGSGGGGSGGGGSQSVLTQPPSASGTPGQRVTISCTGSSSNIGNNAVTWYQQLPGTAPKLLIYDDSHRPSGVPDRFSGSKSGTSASLAISGLRSEDEADYYCGTWDYSLSGYVFGGGTKLTVLG

SEQ ID NO: 14693 - protein, 247 aa, Artificial Sequence
  Description of Artificial Sequence: Synthetic polypeptide
  Synthetic polypeptide for an anti-VEGF scFv
EVQLLESGGGLVQTGGSLRLSCAASGFTFSDYAMSWVRQAPGKGLEWVSSIYPGSGSKYYADSVKGRFAISRDNSKNTLYLQMNSLRAEDTAVYYCARDAWFRGHNVFDYWGQGTLVTVSSGGGGSGGGGSGGGGSQSVLTQPPSASGTPGQRVTISCTGSSSNIGSNNVTWYQQLPGTAPKLLIYSDSHRPSGVPDRFSGSKSGTSASLAISGLQSEDEADYYCGSWDYSLSAYVFGGGTKLTVLG

SEQ ID NO: 14694 - protein, 253 aa, Artificial Sequence
  Description of Artificial Sequence: Synthetic polypeptide
  Synthetic polypeptide for an anti-VEGF scFv
EVQLLESGGGLVQPGGSLRLSCAASGFTFSNYDMSWVRQAPGKGLEWVSGIYPNGGSKYYADSVKGRFTISRDNSKNTLYLQMNSLRAEDTAVYYCARALRQCQRYWCSYADGMDVWGQGTLVTVSSGGGGSGGGGSGGGGSQSVLTQPPSASGTPGQRVTISCTGSSSNIGSNYVSWYQQLPGTAPKLLIYADSQRPSGVPDRFSGSKSGTSASLAISGLRSEDEADYYCGTWDYSLSGYVLGGGTKLTVLG

SEQ ID NO: 14695 - protein, 247 aa, Artificial Sequence
  Description of Artificial Sequence: Synthetic polypeptide
  Synthetic polypeptide for an anti-VEGF scFv
EVQLLESGGGLVQPGGSLRLSCAASGFTFSDYYMSWVRQAPGKGLEWVSAIYSGGGSIYYADSVKGRFTISRDNSKNTLYLQMNSLRAEDTAVYYCARDVQWNKAPRFDYWGQGTLVTVSSGGGGSGGGGSGGGGSQSVLTQPPSASGAPGQRVTISCSGSSSNIGSNDVSWYQQLPGTAPKLLIYADSNRPSGVPDRFSGSKSGTSASLAISGLRSEDEADYYCGSWDYSLSGYVFGGGTKLTVLG

SEQ ID NO: 14696 - protein, 247 aa, Artificial Sequence
  Description of Artificial Sequence: Synthetic polypeptide
  Synthetic polypeptide for an anti-VEGF scFv
EVQLLESGGGLVQPGGSLRLSCAASGFTFSSYSMSWVRQAPGKGLEWVSGISHGGGNKYYADSVKGRFTISRDNSKNTLYLQMNSLRAEDTAVYYCARDLRANNDTGFDYWGQGTLVTVSSGGGGSGGGGSGGGGTQSVLTQPPSSSGTPGQRVTISCTGSSSNIGSNAVTWYQQLPGTAPKLLIYDDNHRPSGVPDRFSGSKSGTSASLAISGLRSEDEADYYCGAWDYSLNAYVFGGGTKLTVLG

SEQ ID NO: 14697 - protein, 253 aa, Artificial Sequence
  Description of Artificial Sequence: Synthetic polypeptide
  Synthetic polypeptide for an anti-VEGF scFv
EVQLLESGGGLVQPGGSLRLSCAASGFTFSNYDMSWVRQAPGKGLEWVSLISHGGGNIYYADSVKGRFTISRDNSKNTLYLQMNSLRAEDTAVYYCARVPVMCTNHWCSYANGMDVWGQGTLVTVSSGGGGSGGGGSGGGGSQSVLTQPPSASGTPGQRVIISCSASSSNIGSNAVYWYQQLPGTAPKLLIYSDNQRPSGVPDRFSGSKSGTSASLAISGLRSEDEADYYCGSWDYSLSAYVFGGGTKLTVLG

SEQ ID NO: 14698 - protein, 247 aa, Artificial Sequence
  Description of Artificial Sequence: Synthetic polypeptide
  Synthetic polypeptide for an anti-VEGF scFv
EVQLLESGGGLVQPGGSLRLSCAASGFTFSGYAMSWVRQAPGKGLEWVSGISHDGGNTYYADSVKGRFTISRDNSKNTLYLQMNSLRAEDTAVYYCARDRRKGPSTEFDYWGQGTLVTVSSGGGGSGGGGSGGGGSQSVLTQPPSLSGTPGQRVTISCTGSSSNIGSNSVSWYQQLPGTAPKLLIYDDNNRPSGVPDRFSGSKSGTSASLAISGLRSEDEADYYCGAWDYSLSAYVFGGGTKLTVLG

SEQ ID NO: 14699 - protein, 253 aa, Artificial Sequence
  Description of Artificial Sequence: Synthetic polypeptide
  Synthetic polypeptide for an anti-VEGF scFv
EVQLLESGGGLVQTGGSLRLSCAASGFTFSDYAMSWVRQAPGKGLEWVSWIYPGDSSIYYADSVKGRFTISRDNSKNTLYLQMNSLRAEDTAVYYCARLLSIDQAQLHYYYDAMDVWGQGTLVTVSSGGGGSGGGGSGGGGSQSVLTQPPSPSGTPGQRVTISCTGSSSNIGNYYVYWYQQLPGTAPKLLIYANSHRPSGVPDRFSGSKSGTSASLAISGLRSEDEADYYCGSWDDSLSAYVFGGGTKLTVLG

SEQ ID NO: 14700 - protein, 290 aa, Artificial Sequence
  Description of Artificial Sequence: Synthetic polypeptide
  Synthetic construct
MKKLLFAIPLVVPFYSHSQVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIKDDDDKSFLEQKLISEEDLNSAVDHHHHHH

SEQ ID NO: 14701 - protein, 290 aa, Artificial Sequence
  Description of Artificial Sequence: Synthetic polypeptide
  Synthetic construct
MKKLLFAIPLVVPFYSHSQVQLVQSGAEVKKPGSSVKVSCKASGYTFTTYYLHWVRQAPGQGLEWMGWIYPGNGHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIKDDDDKSFLEQKLISEEDLNSAVDHHHHHH

SEQ ID NO: 14702 - protein, 238 aa, Artificial Sequence
  Description of Artificial Sequence: Synthetic polypeptide
  phage display generated human antibody
EVQLLESGRGLVQPGGSLRLSCAASGFTFSSYAMSWVRQAPGKGLEWVSAISGSGGSTYYADSVKGRFTISRDNSKNTLYLQMNSLRAEDTAVYYCARWGQGTTVTVSSGGGGSGGGGSGGGGSAQAVLTQPSSVSGAPGQRVTISCTGSSSNIGADYDVHWYQQLPGTAPKLLIYGNNNRPSGVPDRFSGSKSGTSASLAITGLQAEDEADYYCQSYDNSPDAYVVFGGGTKLTVLS

SEQ ID NO: 14703 - protein, 244 aa, Artificial Sequence
  Description of Artificial Sequence: Synthetic polypeptide
  phage display generated human antibody
QVQLVQSGAEVRKPGASVKVSCKTSGYTFIDYYIHWVRQAPGQGLEWMGWVNPVTGTSGSSPNFRGRVTMTTDTSGNTAYMELRSLRSDDTAVFYCARRHQQSLDYWGQGTLVTVSSGGGGSGGGGSGGGGSAQSVLTQPPSVSAPPGQKVTISCSGSSSNIGTNYVSWYQQLPGTAPKLLIYDNHKRPSVIPDRFSGSKSGTSATLGISGLQTGDEADYYCGTWDYSLSTWVFGGGTKLTVLG

SEQ ID NO: 14704 - protein, 240 aa, Artificial Sequence
  Description of Artificial Sequence: Synthetic polypeptide
  phage display generated human antibody
QLQLQESGPGLVKPSGTLSLTCAVSGDSVSSYYWWSWVRQPPGKGLEWIGEIFRDGSSNYNRSLKSRVTISPDKPKNQFSLRLSSVTAADTAIYYCARHIRGYDAFDIWGRGTLVTVSSGGGGSGGGGSGGGGSAQSVLTQPPSVSGAPGQRVTISCTGSSSNIGAGYDVHWYQQFPGRAPKLLIYGNTNRPSGVPDRFSGSKSDISASLAITGLQAEDEADYYCQSYDSNLTGVFGGGT

SEQ ID NO: 14705 - protein, 244 aa, Artificial Sequence
  Description of Artificial Sequence: Synthetic polypeptide
  phage display generated human antibody
QVQLVQSGAEVRKPGASVKVSCKTSGYTFMDYYIHWVRQAPGQGLEWMGWSNPVTGTSGSSPKFRGRVTLTTDTSGNTAYLDLRSLRSDDTAVFYCARRHQQSLDYWGQGTMVTVSSGGGGSGGGGSGGGGSAQSVLTQPPSVSAAPGQKVTISCSGSSSNIGNNYVSWYQQLPGTAPKLLMYENSKRPSGIPDRFSGSKSGTSGTLGITGLQTGDEADYYCGTWDTSLRAWVFGGGTKVTVLG

SEQ ID NO: 14706 - protein, 244 aa, Artificial Sequence
  Description of Artificial Sequence: Synthetic polypeptide
  phage display generated human antibody
QVQLQQSGAEVRKPGASAKVSCKTSGYTFIDYYIHWVRQAPGQGLEWMGWINPVTGASGSSPNFRGRVTLTTDTSGNTAYMELRSLRSDDTAVFYCARRHQQSLDYWGRGTTVTVSSGGGGSGGGGSGGGGSAQSVVTQPPSVSAAPGQKVTISCSGRTSNIGNNYVSWYQQVPGAPPKLLIFDNNKRPSGTPARFSGSKSGTSATLAISGLQTGDEADYYCGTWDTTLRGFVFGPGTKVTVLG

SEQ ID NO: 14707 - protein, 250 aa, Artificial Sequence
  Description of Artificial Sequence: Synthetic polypeptide
  phage display generated human antibody
QLQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGRGTLVTVSSGGGGSGGGGSGGGGSAQSALTQPPSASGSPGQSVTISCSGSSSDIGDYNHVSWYQQHPGKAPKLMIYDVNKWPSGVPDRFSGSKSGNTASLTVSGLQAEDEADYYCSSYSGIYNLVFGGGTKVTVLG

SEQ ID NO: 14708 - protein, 250 aa, Artificial Sequence
  Description of Artificial Sequence: Synthetic polypeptide
  phage display generated human antibody
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDHYYDSSGYLDYWGQGTLVTVSSGGGGSGGGGSGGGGSALNFMLTQPHSVSESPGKTVTISCTRSSGSIAFDYVQWYQQRPGSAPTTVIYEDNQRPSGVPDRFSASIDSSSNSASLTISALKTEDEADYYCQSYDNSNSWVFGGGTKLTVLG

SEQ ID NO: 14709 - protein, 242 aa, Artificial Sequence
  Description of Artificial Sequence: Synthetic polypeptide
  phage display generated human antibody
KVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDVRNAFDIWGRGTTVTVSSGGGGSGGGGSGGGGSAQSVLTQPPSVSVSPGQTTSITCSRDKLGEQYVYWYQQRPGQSPILLLYQDSRRPSWIPERFSGSNSGDTATLTISGTQALDEADYYCQAWDNSSYVAFGGGTKVTVLG

SEQ ID NO: 14710 - protein, 245 aa, Artificial Sequence
  Description of Artificial Sequence: Synthetic polypeptide
  phage display generated human antibody
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARGGELWNPYLDYWGQGTLVTVSSGGGGSGGGGSGGGGSALPVLTQPPSVSVAPGKTARITCGGNDIASKSVQWFQQKPGQAPVLVIYYDSDRPSGIPERFSGSNSENTATLTISRVEAGDEADYYCQVWDSSSDHPVFGGGTKLTVLG

SEQ ID NO: 14711 - protein, 250 aa, Artificial Sequence
  Description of Artificial Sequence: Synthetic polypeptide
  phage display generated human antibody
QVQLVQSGAEVKKPGESLKISCKGSGYTFTNYWIAWVRQMPGKGLEWMGIIYPDDSDTRYNPSFQGQVTMSADKSIDTAYLQWSSLKASDTAIYYCARPSGWNDNGYFDYWGRGTTVTVSSGGGGSGGGGSGGGGSALNFMLTQPHSVSASPGKTVTLSCTGSSGSIASNYVQWYRQRPGSAPTTVIYDDNQRPSGVPDRFSGSIDSSSNSASLTISGLKTEDEADYYCQSFDNDNHWVFGGGTKLTVLG

SEQ ID NO: 14712 - protein, 247 aa, Artificial Sequence
  Description of Artificial Sequence: Synthetic polypeptide
  phage display generated human antibody
QVQLQESGPGLVRSSGILSLTCSVSGVSVSSNNWWSWVRQTPGKGLEWIGEIYQTGTTNYNPSLKSRVAISLDKSRNQFSLILKSVTAADTAVYYCARTSSAWSNADWGKGTMVTVSSGGGGSGGGGSGGGGSALSSELTQDPSASGSPGQSVSISCTGTSSDVGGYNYVSWYQQHPGKAPKLMISEVTKRPSGVPDRFSGSKSGNTASLTVSGLQAEDEADYYCSSFGANNNYLVFGGGTKLTVLG

SEQ ID NO: 14713 - protein, 251 aa, Artificial Sequence
  Description of Artificial Sequence: Synthetic polypeptide
  phage display generated human antibody
QVQLQESGPRLVKPSQTLSLTCTVSNDSIISGDYFWSWIRQPPGKGLEWIGNIFYTGSTSYNPSLKSRLTMSLDTSKNQFSLRLSSVTAADTAVYFCARGRQGMNWNSGTYFDSWGRGTLVTVSSGGGGSGGGGSGGGGSALSYVLTQPPSVSVAPGKTANITCGGKNIGNKSVQWYQQKPGQAPVVVMYYDSDRPSGIPERFSGSNAGNTATLTIDRVEAGDEADYYCQVWDKSSDRPVFGGGTKLTVLG

SEQ ID NO: 14714 - protein, 245 aa, Artificial Sequence
  Description of Artificial Sequence: Synthetic polypeptide
  phage display generated human antibody
QVQLVQSGAEVKKPGASVKVSCKTSGYTFMEYYIHWVRQAPGQGLEWMGWSNPVTGTSGSSPKFRGRVTLTTDTSGNTAYLDLRSLRSDDTAVFYCARRHQQSLDYWGQGTLVTVSSGGGGSGGGGSGGGGSAQSVVTQPPSASGSPGQSVTISCSGYSSSNIGNNAVSWYQQLPGTAPKLLIFDNNKRPSGIPARFSGSQSGTTATLGITGLQTGDEADYFCGTWDSSLSAFVFGSGTKVTVLG

SEQ ID NO: 14715 - protein, 246 aa, Artificial Sequence
  Description of Artificial Sequence: Synthetic polypeptide
  phage display generated human antibody
EVQLVQSGAEVKKPGSSVKVSCKASGGSFSNYDFSWVRQAPGQGLEWMGEIINAFGSSRYAQKFQDRVTITADESASTAYMELRGLTSEDTATYYCARAERWELNMAFDMWGRGTLVTVSSGGGGSGGGGSGGGGSAQSVLTQPPSVSVAPGQTARITCGGDNIGRKNVHWYQQRPGLAPVLVVYDDTDRPSGIPERFSGSNSGDTATLTITWVEAGDEADYYCQLWDSDTYDVLFGGGTKLTVLG

SEQ ID NO: 14716 - protein, 247 aa, Artificial Sequence
  Description of Artificial Sequence: Synthetic polypeptide
  phage display generated human antibody
EVQLVQSGAEVKKPGSSVKVSCKSSGGPFSSYGISWVRQAPGQGLEWMGGISPIFGTANYAQKFQGRVTITADESTETAYMELSSLRSEDTAVYYCARDESPVGFYALDIWGRGTTVTVSSGGGGSGGGGSGGGGSALSYELTQPPSVSVAPGQTARINCGGDKIGSRSVHWYQQKPGQAPVMVVYDDSDRPSGIPERFSGSNSGNTATLTISSVEAGDEADYYCQVWDGSTDPWVFGGGTKVTVLG

SEQ ID NO: 14717 - protein, 255 aa, Artificial Sequence
  Description of Artificial Sequence: Synthetic polypeptide
  phage display generated human antibody
EVQLVQSGAEMKKPGSSVKVSCKASGGTFSSYAVNWVRQAPGQGLEWMGGIIPIFDTSNYAQKFQGRLTMTADDSTNTAYMELRSLRSEDTAVYYCARGAPRGTVMAFSSYYFDLWGQGTLVTVSSGGGGSGGGGSGGGGSALNFMLTQPHSVSESPGKTVIISCAGSGGNIATNYVQWYQHRPGSAPITVIYEDNQRPSGVPDRFSGSVDSSSNSASLTISGLQTEDEADYYCHSYDNTDQGVFGTGTKVTVLG

SEQ ID NO: 14718 - protein, 253 aa, Artificial Sequence
  Description of Artificial Sequence: Synthetic polypeptide
  phage display generated human antibody
EVQLVESGGGLVQPGRSLRLSCAASGFTFDDYDMHWVRQAPGKGLEWVSSISWSGGTIGYADSVKGRFTVSRDNAKNSLYLQMNSVRAEDTALYYCAKDRGAVAALPDYQYGMDVWGRGTLVTVSSGGGGSGGGGSGGGGSAQSALTQPASVSGSPGQSITISCTGTSSDIGSYNLVSWYQQHPGKAPKLMIYEDYKRASGVSNHFSGSKSGNTASLTISGLQAEDEADYYCSSYAGSSAWVFGGGTKVTVLG

SEQ ID NO: 14719 - protein, 245 aa, Artificial Sequence
  Description of Artificial Sequence: Synthetic polypeptide
  phage display generated human antibody
EVQLVQSGAEVRKPGSSMKVSCKASGDTFRNFAFSWVRQAPGQGLEWMGGVIPLVGPPKYAQKFQGRLTITADESTSTSYMDLTSLTLEDTAVYFCARGGVYAPFDKWGQGTLVTVSSGGGGSGGGGSGGGGSAQSVVTQPPSVSEAPRQRVTISCSGSSSNIGNNAVNWYQQLPGKAPKLLIYYNDLLPSGVSDRFSGSKSGTSASLAISGLQSEDEADYYCAAWDDSLNGWVFGGGTKVTVLG

SEQ ID NO: 14720 - protein, 251 aa, Artificial Sequence
  Description of Artificial Sequence: Synthetic polypeptide
  phage display generated human antibody
EVQLVQSGAEVKKPGSSVKVSCKASGGTFKTYAINWVRQAPGQGLEWMGGIIPVLGTANYVQKFQGRVTITADESTTTAYMELRGLRSEDTAVYYCARGEGSGWYDHYYGLDVWGQGTLVTVSSGGGGSGGGGSGGGGSAQSVLTQPPSASGTPGQRVTISCSGSSSNIGSNTVNWYRQLPGTAPKLLIFGDDQRPSGVPDRFSGSRSGTSVSLAISGLQSEDEADYYCAAWDDSLNGGVFGGGTKLTVLG

SEQ ID NO: 14721 - protein, 248 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSAQAVLTQPSSVSAAPGQKVTISCSGSSSNIGNNYVSWYQQLPGTAPKLLIYDNNKRPSGIPDRFSGSRSGTSATLGITGLQTGDEADYYCGTWDSSLSAVVFGTGTKLTVLG

SEQ ID NO: 14722 - protein, 250 aa, Artificial Sequence
  Description of Artificial Sequence: Synthetic polypeptide
  phage display generated human antibody
QLQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGKGTLVTVSSGGGGSGGGGSGGGGSAQSALTQPASVSGSPGQSIAISCTGTSSDVGGYNYVSWYQQHPGKAPKLMIYAVTNRPSGVSDRFSGSKSGNTASLTISGLQADDEADYYCSSYTSSSSLVFGGGTKLTVLG

SEQ ID NO: 14723 - protein, 240 aa, Artificial Sequence
  Description of Artificial Sequence: Synthetic polypeptide
  phage display generated human antibody
GVQLVESGGGLVKPGGSLRLSCAASGFTFSSYTMNWVRQAPGKGLEWVSYISSSGSATYYADSVKGRFTISRDNANNSLYLQMNSLRAEDTAVYYCARGYRYGMDVWGQGTLVTVSSGGGGSGGGGSGGGGSGIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 14724 - protein, 245 aa, Artificial Sequence
  Description of Artificial Sequence: Synthetic polypeptide
  phage display generated human antibody
EVQLLESGGGLVQPGGSLRLTCAASGFTFSSYAMSWVRQAPGKGLEWVSAISGSGGSTYYADSVKGRFTISRDNSKNTLYLQMNSLRAEDTAVYYCARDLAVAGIDYWGRGTMVTVSSGGGGSGGGGSGGGGSAQSVLTQPPSASGTPGQRVTISCSGSSSNIRSNYVYWYQQFPGTAPKLLIYRNNQRPSGVPDRFSGSKSGTSASLAISGLRSEDEADYYCAAWDDTLDAYVFAAGTKLTVLG

SEQ ID NO: 14725 - protein, 251 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSGSPGRTVTISCTRSSGSIATNYVQWYQQRPGSSPTIVIYEDNQRPSGVPDRFSGSIDTSSNSASLTISGLKTEDEADYYCQSYDSNNLGVVFGGGTQLTVLS

SEQ ID NO: 14726 - protein, 249 aa, Artificial Sequence
  Description of Artificial Sequence: Synthetic polypeptide
  phage display generated human antibody
QVQLQQSGAEVRKPGASVKISCKTSGYTFMDYYIHWVRQAPGQGLEWMGWSNPVTGTSGSSPKFRGRVTLTTDTSGNTAYLDLRSLRSDDTAVFYCARRHQQSLDYWGQGTLVTVSSGGGGSGGGGSGGGGSAQAVLTQPSSLSASPGASASLTCTLRSDINVGSYSINWYQQKPGSPPQYLLNYRSDSDKQQGSGVPSRFSGSKDASANAGILLISGLQSEDEADYYCMIWYRTAWVFGGGTKVTVLG

SEQ ID NO: 14727 - protein, 244 aa, Artificial Sequence
  Description of Artificial Sequence: Synthetic polypeptide
  phage display generated human antibody
QVQLVQSGAEVRKPGASVKVSCKTSGYTFIEYYIHWVRQAPGQGLEWMGWSNPVTGTSGSSPKFRGRVTLTTDTSGNTAYLDLRSLRSDDTAVFYCARRHQQSLDYWGRGTTVTVSSGGGGSGGGGSGGGGSAQSVLTQPPSVSAAPGQKVTISCSGTNSNIGNYYVSWYQQLPGTAPKLLIYDNNKRPSGVPDRFSGSKSGTSASLVISGLRSEDEADYYCAAWDGSLTAWVFGGGTKVTVLG

SEQ ID NO: 14728 - protein, 250 aa, Artificial Sequence
  Description of Artificial Sequence: Synthetic polypeptide
  phage display generated human antibody
QVQLQESGPGLVKPSGTLSLTCAVSGDSISSSNWWTWVRQPPGKGLEWIGEIFHSGTTNYNPSLNNRVTISLDESRNQFSLELSSVTAADTAIYYCARDSGNYDDNRGYDYWGRGTLVTVSSGGGGSGGGGSGGGGSAQSVLTQPPSVSGAPGQRVTISCAGTSSNIGAGFDVHWYQLLPGRAPKLLIYGNNNRPSGVPDRFSGSKSGTSASLAISGLQSEDEGDYYCAAWDDTVGGPVFGGGTKLTVLG

SEQ ID NO: 14729 - protein, 250 aa, Artificial Sequence
  Description of Artificial Sequence: Synthetic polypeptide
  phage display generated human antibody
QVQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGRGTLVTVSSGGGGSGGGGSGGGGSAQSALTQPAAVSGSPGQSITISCTGSSSDVGGYNYVSWYQQHPGKAPKLLIYDVSDRPSGVSYRFSGSKSGNTASLTISGLQAEDEADYYCSSYTATGTLVFGGGTKLTVLG

SEQ ID NO: 14730 - protein, 251 aa, Artificial Sequence
  Description of Artificial Sequence: Synthetic polypeptide
  phage display generated human antibody
QVQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGQGTTVTVSSGGGGSGGGGSGGGGSAQSALTQPASVSGSPGQSITISCTGTSSDVGGYNYVSWYQQHPGKAPKLMIYEVSNRPLGVSNRFSGSKSGNTASLTISGLQAEDEGDYYCSSYTSSTTLIVFGGGTKLTVLG

SEQ ID NO: 14731 - protein, 248 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSAQSVLTQPPSVSGTTGQRVILSCSGGNSNIGYNSVNWYQQLPGTAPKLLIYTDDQRPSGVPDRFSGSRSGTSASLAISGLQSEDEADYYCATWDDSLNAGVFGGGTKLTVLG

SEQ ID NO: 14732 - protein, 245 aa, Artificial Sequence
  Description of Artificial Sequence: Synthetic polypeptide
  phage display generated human antibody
QVQLVQSGAEVRKPGASVRVSCKTSGYTFLEYYIHWVRQAPGQGLEWMAWSNPVTGTSGSSPKFRGRVTLTADTSGNTAYLDLKSLTSDDTAIFYCARRHQQSLDYWGQGTLVTVSSGGGGSGGGGSGGGGSAQSVLTQPPSVSAAPGQTVTISCSGSNSNIGNNHVSWYRQLPETAPKLLIYDNNKRPSGIPDRFSGSKSGTSATLDITGLQTGDEADYYCATWDNSLSAPWVFGGGTKLTVLG

SEQ ID NO: 14733 - protein, 252 aa, Artificial Sequence
  Description of Artificial Sequence: Synthetic polypeptide
  phage display generated human antibody
QVQLQESGAEVKKPGSSVKVSCKASGGTFSSSAISWVRQAPGQGLEWMGGIIPVFGTANYAQKFQDRVTITADESTSTAYLELSRLTSEDTAVYYCASRGEYDYGDYDVYYYYMEVWGQGTLVTVSSGGGGSGGGGSGGGGSAQSVLTQPPSVSVAPGQTARLTCGANNIGSTSVHWYQQKPGQAPVLVIYDDTDRPSGIPERFSGSNSGNTATLTIRRVEAGDEADYYCQVWDTNSDHVIFGGGTKLTVLG

SEQ ID NO: 14734 - protein, 249 aa, Artificial Sequence
  Description of Artificial Sequence: Synthetic polypeptide
  phage display generated human antibody
EVQLVQSGAEVKKPGSSVKVSCQASGGTFTSHAMYWVRQAPGQGLEWMGGIIPIFGRTNYAQKFQGRVTFTADMSTSTAYMEMTSLRSDDTAVYYCARGDNWNDLYPIDYWGRGTLVTVSSGGGGSGGGGSGGGGSALNFMLTQPHSVSESPGKTVTISCTRSSGSIATTYVQWFQQRPGSSPTTVIYDDDQRPSGVPDRFSGSIDSSSNSASLTISGLMPEDEADYYCQSYDNTDLVFGGGTQLTVLS

SEQ ID NO: 14735 - protein, 248 aa, Artificial Sequence
  Description of Artificial Sequence: Synthetic polypeptide
  phage display generated human antibody
EVQLVQSGAEVKKPGASVKVSCKVSGYSLSELSMHWVRQAPGKGLEWMGGFDPQNGYTIYAQEFQGRITMTEDTSTDTVYMELGSLRSEDTAVYFCAAIEITGVNWYFDLWGKGTLVTVSSGGGGSGGGGSGGGGSALSSELTQDPDVSVALGQTVRITCQGDSLKKFYPGWYQQKPGQAPLLVLYGENIRPSRIPDRFSGSSSGNTATLTITGAQAEDEAVYYCNSREASVHHVRVFGGGTKLTVLG

SEQ ID NO: 14736 - protein, 251 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSALNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNQGVVFGGGTKLTVLG

SEQ ID NO: 14737 - protein, 251 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTGSSGSIASNYVQWYQQRPGSAPTTLIYEDDQRPSGVPDRFSGSVDSSSNSASLTISGLKTEDEADYYCQSYDRSNQAVVFGGGTKLTVLG

SEQ ID NO: 14738 - protein, 253 aa, Artificial Sequence
  Description of Artificial Sequence: Synthetic polypeptide
  phage display generated human antibody
QVQLVQSGPEVKKPGASVEVSCKASGYTFTGDYMHWVRQAPGQGPEWMGWINPQTGVTKYAQKFQGRVTMARDTSINTAYMELRGLRSDDTAVYYCVREDHNYDLWSAYNGLDVWGQGTLVTVSSGGGGSGGGGSGGGGSAQSVLTQPPSVSAAPGQKVTISCSGSSSNIGNNHVSWYQQLAGTAPKLLIFDNDKRPSGIPDRFSGSKSGTSATLGITGLQTGDEADYYCGTWDKSPTDIYVFGSGTKLTVLG

SEQ ID NO: 14739 - protein, 247 aa, Artificial Sequence
  Description of Artificial Sequence: Synthetic polypeptide
  phage display generated human antibody
QVQLQESGPGLVKPSGTLSLTCAVSGGSISSSNWWSWVRQAPGKGLEWIGEIYYGGSTNYNPSLKSRVTLSVDKSKNQFSLRLISVTAADTAVYYCARSSGLYGDYGNLWGRGTLVTVSSGGGGSGGGGSGGGGSAQSVVTQPPSVSAAPGQKVTISCSGSASNIGDHYISWYQQFPGTAPKLLISDNDQRPSGIPDRFSGSKSGTSATLGITGLQTGDEADYYCGTWDSNLSSWVFGSGTKVTVLG

SEQ ID NO: 14740 - protein, 250 aa, Artificial Sequence
  Description of Artificial Sequence: Synthetic polypeptide
  phage display generated human antibody
EVQLVQSGAEVKKPGATLKVSCKVSAYTFTDYSMHWVQQAPGKGLKWMGLIDLEDGNTIYAEEFQDRVTITADTSTDTAYMDLSSLRSEDTAVFYCAISPLRGLTADVFDVWGQGTLVTVSSGGGGSGGGGSGGGGSAQSALTQPASASGSPGQSITISCTGTSSDIGRYDFVSWYQRQPGKAPKLMIYDVINRPSGVSSRFSGSKSGNTASLTISGLQAEDEADYYCSSYAGSTTLYVFGTGTKLTVLG

SEQ ID NO: 14741 - protein, 246 aa, Artificial Sequence
  Description of Artificial Sequence: Synthetic polypeptide
  phage display generated human antibody
QVQLQESGPGLVKPSATLSLTCAVSGGSISSNHWWSWVRQSPGKGLEWIGEIYTYGGANYNPSLKSRVDISMDKSKNQFSLHLSSVTAADTAVYYCGRHLTGYDCFDIWGQGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGTGTQLTVLS

SEQ ID NO: 14742 - protein, 249 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTRSSGSIASKYVQWYQQRPGSAPTSVIYEDNQRPSGVPDRFSGSIDSASNSASLTISGLKTEDEADYYCQSDDGSSVVFGGGTKVTVLG

SEQ ID NO: 14743 - protein, 257 aa, Artificial Sequence
  Description of Artificial Sequence: Synthetic polypeptide
  phage display generated human antibody
EVQLVQSGAEVKKPGASVKVSCKASGYSFPSSGLSWVRQAPGQGPEWMGWIGIYNGNTDYAQKFQGRVTMTTDKSTSTAYMELRSLRSDDTAVYYCARDSVGSISVAGTMQYYYFAMDVWGQGTLVTVSSGGGGSGGGGSGGGGSAQSVLTQPPSASGSPGQSVTISCAGTRYDIGTYNYVSWYQQHPAKGPKLIIYAVSERPSGVPNRFSGSKSGNTASLTVSGLRAEDEAHYYCSSYAGNNNVIFGGGTKVTVLG

SEQ ID NO: 14744 - protein, 247 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTMVTVSSGGGGSGGGGSGGGGSAQSVLTQPPSASGTPGQRVTISCSGSFSNIGGNYVNWYQQLPGTAPKLLIYGNNQRPSGVPDRFSSFKSGTSASLAISGLRSEDEADYYCATWDDSQTVLFGGGTKLTVLG

SEQ ID NO: 14745 - protein, 246 aa, Artificial Sequence
  Description of Artificial Sequence: Synthetic polypeptide
  phage display generated human antibody
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARWNGFLTAHDSWGRGTMVTVSSGGGGSGGGGSGGGGSAQSVLTQPPSASGTPGQRVTISCSGSSSNIGTNYVYWYQQFPGTAPKLLIYRSNRRPSGVPDRFSASKSGTSASLVISGLRSEDEADYYCAAWDDRLNGEMFGGGTKVTVLG

SEQ ID NO: 14746 - protein, 243 aa, Artificial Sequence
  Description of Artificial Sequence: Synthetic polypeptide
  phage display generated human antibody
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARWSGRFYDFWGQGTTVTVSSGGGGSGGGGSGGGGSAQSVLTQPPSASGTPGQRITISCSGSSSNIGSNYVYWYQQLPGTAPKILIYRNNQRPSGVPERFSGSKSGTSASLAISGLRSEDEADYYCAAWDDSLSEVFGGGTKVTVLG

SEQ ID NO: 14747 - protein, 246 aa, Artificial Sequence
  Description of Artificial Sequence: Synthetic polypeptide
  phage display generated human antibody
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDKGYSGFDYWGRGTLVTVSSGGGGSGGGGSGGGGSAQSVLTQPPSASGTPGQRVTISCSGSSSNIGRHTVNWYQQLPGTAPKLLIYSNNQRPSGVPDRFSGSKSGTSASLAISGLQSEDEGHYHCAAWDDTLNGDVVFGGGTKVTVLG

SEQ ID NO: 14748 - protein, 251 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSALNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPYVVFGGGTKLTVLG

SEQ ID NO: 14749 - protein, 248 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSAQSVVTQPPSVSAAPGQKVTISCSGSSSNIGNNYVSWYKQLPGTAPKLLIYDNNKRPSGIPDRFSGSKSGTSATLGITGLQTGDEADYYCGTWDSSLSGVVFGGGTKLTVLG

SEQ ID NO: 14750 - protein, 251 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTVTISCTRSSGSIASNYVQWYQQRPGSSPTTLIYDDNQRPSGVPDRFSGSIDSSSNSASLTISGLKTEDEADYYCQSYDSSNLGVVFGGGTKLTVLG

SEQ ID NO: 14751 - protein, 250 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTATISCTGSGGSIARSYVQWYQQRPGRAPSIVIYEDYQRPSGVPDRFSGSIDSSSNSASLTITGLKTDDEADYYCQSSDDNNNVVFGGGTKVTVLG

SEQ ID NO: 14752 - protein, 248 aa, Artificial Sequence
  Description of Artificial Sequence: Synthetic polypeptide
  phage display generated human antibody
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQAVLTQPSSVSAAPGQKVTISCSGSSSNIGNNYVSWYQQLPGTAPKLLIYDNNERPSGIPDRFSGSKSGTSATLGITGLQTGDEADYYCGTWDSSLSTVVFGTGTKVTVLG

SEQ ID NO: 14753 - protein, 249 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTVSCTGSGGNIASNYVQWYQQRPDSAPTLVIFEDTQRPSGVPARFSGSIDSSSNSASLIISSLRTEDEADYYCQSSDSNRVVFGGGTKVTVLG

SEQ ID NO: 14754 - protein, 241 aa, Artificial Sequence
  Description of Artificial Sequence: Synthetic polypeptide
  phage display generated human antibody
QVQLQESGPGLVKPSETLSLTCNVSGGSIRNYFWSWIRQPPGQGLEYIGYIYYSGTTDYNPSLKGRVTISLDTSKTQFSLKLNSVTAADTAFYYCVRGPNKYAFDPWGQGTLVTVSSGGGGSGGGGSGGGGSALSYELTQPPSVSVSPGQTASITCSGDKLGDKFASWYQQKAGQSPVLVIYRDTKRPSGIPERFSGSNSGNTATLTISGTQAMDEADYYCQAWDSSTAVFGTGTKVTVLG

SEQ ID NO: 14755 - protein, 251 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTRSSGSIDNNYVQWYQQRPGSSPTTVIFEDNQRPSGVPDRFSGSIDSSSNSASLTISGLKTEDEADYYCQSYDSHNQGVVFGGGTKLTVLG

SEQ ID NO: 14756 - protein, 248 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQSVLTQPPSVSAAPGQKVTISCSGSSSNIGNSYVSWYKQLPGTAPKVLIYDNQKRSSGIPDRFSASKSGTSATLGITGLRTEDEADYYCGTWDTSLSAVVFGGGTKLTVLG

SEQ ID NO: 14757 - protein, 248 aa, Artificial Sequence
  Description of Artificial Sequence: Synthetic polypeptide
  phage display generated human antibody
EVQLVESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQSVVTQPPSVSAAPGQKVTISCSGNFSNIEYNYVSWYQHLPGTAPKLLIFDNNQRPSWIPDRFSGSKSGTSATLGITGLQTGDEADYYCGTWDSSLNAGVFGGGTKVTVLG

SEQ ID NO: 14758 - protein, 245 aa, Artificial Sequence
  Description of Artificial Sequence: Synthetic polypeptide
  phage display generated human antibody
EVQLLESGGGLVRPGGSLRLSCAASGFTFSSYAMSWVRQAPGKGLEWVSAISGSGGSTYYADSVKGRFTISRDNSKNTLYLQMNSLRAEDTAVYYCAKDRRGVLDPWGKGTMVTVSSGGGGSGGGGSGGGGSAQSVLTQPPSVSGAPGQRVTISCTGSSSNIGAGYDVHWYQHLPGTAPRLLIYGNSNRPSGVPDRFSGSKSGTSASLAISGLQAEDEADYYCQSYDSSLSDWVFGGGTKVTVLG

SEQ ID NO: 14759 - protein, 250 aa, Artificial Sequence
  Description of Artificial Sequence: Synthetic polypeptide
  phage display generated human antibody
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTVTISCARSSGSIASNYVQWYQQRPGSSPTTLIYEDRQRPSGVPDRFSGSIDSSSNSASLTISGLKTEDEADYYCQSYDSSDHVVFGGGTKLTVLG

SEQ ID NO: 14760 - protein, 249 aa, Mus sp.
SYELTQPPSVSVAPGQTARITCSGDALGDKYASWYQQKPGQAPVLVIYEDSKRPSGIPERFSGSNSGNTATLTISGTQAEDEADYYCSVWDGDWGMPVFGGGTKLTVLGSGGSTITSYNVYYTKLSSSGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGIIYPSNVAVWGQGTLVTVSS

SEQ ID NO: 14761 - protein, 110 aa, Artificial Sequence
  Description of Artificial Sequence: Synthetic polypeptide
  Single chain antibody or single chain antibody domain.
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVL

SEQ ID NO: 14762 - protein, 119 aa, Artificial Sequence
  Description of Artificial Sequence: Synthetic polypeptide
  Single chain antibody or single chain antibody domain.
QVQLVQSGGGLVKPGGSLRLSCAASGFSFNTYDMNWVRQAPGKGLEWVSSISSSSSYIYYADSVKGRFTISRDNAKNSLYLQMNSLRAEDTAVYYCARDGVATTPFDYWGQGTLVTVSS

SEQ ID NO: 14763 - protein, 122 aa, Artificial Sequence
  Description of Artificial Sequence: Synthetic polypeptide
  Single chain antibody or single chain antibody domain.
QVQLVQSGGGLVQPGRSLRLSCAASGFTFDDYAMHWVRQAPGKGLEWVSGISWNSGSIGYADSVKGRFTISRDNAKNSLYLQMNSLRPEDTAVYYCARDLGAKQWLEGFDYWGQGTLVTVSS

SEQ ID NO: 14764 - protein, 122 aa, Artificial Sequence
  Description of Artificial Sequence: Synthetic polypeptide
  Single chain antibody or single chain antibody domain.
QVQLQESGGGLVKPGGSLRLSCAASGFTFSSYAMSWVRQAPGKGLEWVSTISGSGGSTYYADSVKGRFTISRDNSKNTLYLQMNSLRAEDTAVYYCAKGYSSSWSEVASGYWGQGTLVTVSS

SEQ ID NO: 14765 - protein, 119 aa, Artificial Sequence
  Description of Artificial Sequence: Synthetic polypeptide
  Single chain antibody or single chain antibody domain.
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAVGFDYWGQGTLVTVSS

SEQ ID NO: 14766 - protein, 118 aa, Artificial Sequence
  Description of Artificial Sequence: Synthetic polypeptide
  Single chain antibody or single chain antibody domain.
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSS

SEQ ID NO: 14767 - protein, 111 aa, Artificial Sequence
  Description of Artificial Sequence: Synthetic polypeptide
  Single chain antibody or single chain antibody domain.
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALFGGGTKLTVLG

SEQ ID NO: 14768 - protein, 108 aa, Artificial Sequence
  Description of Artificial Sequence: Synthetic polypeptide
  Single chain antibody or single chain antibody domain.
NFMLTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVL

SEQ ID NO: 14769 - protein, 108 aa, Artificial Sequence
  Description of Artificial Sequence: Synthetic polypeptide
  Single chain antibody or single chain antibody domain.
DIVMTQSPSSLSASVGDRVTITCRASQGIRNDLGWYQQKAGKAPKLLIYAASSLQSGVPSRFSGSGSGTDFTLTISSLQPDDFATYFCQQAHSFPPTFGGGTKVEIKR

SEQ ID NO: 14770 - protein, 112 aa, Artificial Sequence
  Description of Artificial Sequence: Synthetic polypeptide
  Single chain antibody or single chain antibody domain.
QSVLTQPPSVSGAPGQRVTISCTGRHSNIGLGYGVHWYQQLPGTAPKLLIYGNTNRPSGVPDRFSGFKSGTSASLAITGLQAEDEADYYCQSYDRRTPGWVFGGGTKLTVLG

SEQ ID NO: 14771 - protein, 111 aa, Artificial Sequence
  Description of Artificial Sequence: Synthetic polypeptide
  Single chain antibody or single chain antibody domain.
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVL

SEQ ID NO: 14772 - protein, 531 aa, Artificial Sequence [sequence omitted]

SEQ ID NO: 14773 - protein, 519 aa, Artificial Sequence [sequence omitted]

SEQ ID NO: 14774 - protein, 509 aa, Artificial Sequence
  Description of Artificial Sequence: Synthetic polypeptide
  Single chain antibody or single chain antibody domain.
RHGPGAAGAVWGRPGQAWGVPETILCSLWIQLQHLHELGPPGSREGAGVGLIHLHILRRLSEGPIHHLQRQRQELTVSANEQPESRGHGCVLLCERWGGYDPLLLGPGHPGHRLLRWRRFRRRWLWRWRIAVCVDAATLSVWGPRAEGHHLLHWEQLQHRGRLCTLVPAASRNSPQTPHLWQQSSLRGPPILWLQVWHLSLPGHHWAPGGGLLLPVLQQPECPIRRRDQADRPREFRCWYFRFRCFRRFRFKASGAAGAVWGRGEKAAGVSEDLLGFWIQLYQLLDRLGAPDARERPGVHGAHLSWLHQIQPVLPRPGHHLSRQVRQHCLLAMEQSEALGQRRVFLCETRGILQFQLRKVAILPALGPGHPGHRLLRWRRFRRRWLWRWRIAVCVDAAALSVCGPRTEGHHLLLWKQLQHWELCILVPAAPRNSPQTPHLSHQSARRGPPILWLQVWHLSLPGHQWVPVRGGLLLCLLGLHPLGLGVRRRNQADRPRSAAPPPPPLSGR

SEQ ID NO: 14775 - protein, 126 aa, Artificial Sequence
  Description of Artificial Sequence: Synthetic polypeptide
  Single chain antibody or single chain antibody domain.
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEGPYCSSTSCYGAFDIWGQGTLVTVSS

SEQ ID NO: 14776 - protein, 119 aa, Artificial Sequence
  Description of Artificial Sequence: Synthetic polypeptide
  Single chain antibody or single chain antibody domain.
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS

SEQ ID NO: 14777 - protein, 110 aa, Artificial Sequence
  Description of Artificial Sequence: Synthetic polypeptide
  Single chain antibody or single chain antibody domain.
QSVLTQPPSVSAAPGQKVTISCSGSSSNIGNNYVSWYQQLPGTAPKLLIYGHTNRPAGVPDRFSGSKSGTSASLAISGFRSEDEADYYCAAWDDSLSGWVFGGGTKLTVL

SEQ ID NO: 14778 - protein, 111 aa, Artificial Sequence
  Description of Artificial Sequence: Synthetic polypeptide
  Single chain antibody or single chain antibody domain.
QSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVL

SEQ ID NO: 14779 - protein, 119 aa, Artificial Sequence
  Description of Artificial Sequence: Synthetic polypeptide
  Single chain antibody or single chain antibody domain.
QVQLVESGGGVVQPGRSLRLSCAASGFTFSDYYIHWVRQAPGKGLEWMAVISYDGNNKYYAASVKDRFTISRDNSKNTVSLQMNSLRAEDTAVYYCARDLYGDYALDYWGQGTLVTVSS

SEQ ID NO: 14780 - protein, 113 aa, Artificial Sequence
  Description of Artificial Sequence: Synthetic polypeptide
  Single chain antibody or single chain antibody domain.
QVQLVESGGGVVQPGRSLRLSCAASGFTFSSYGMHVISYDGSNKYYADSVKGWVRQAPGKGLEWVARFTISRDNSKNTLYLQMNSLRAEDTAVYYCAKYPLNWGQGTLVTVSS

SEQ ID NO: 14781 - protein, 110 aa, Artificial Sequence
  Description of Artificial Sequence: Synthetic polypeptide
  Single chain antibody or single chain antibody domain.
QSALTQPASVSGSPGQSITISCTGTSSDVGGYNYVSWYQQHPGKAPKLMIYEVSNRPSGVSNRFSGSKSGNTASLTISGLQAEDEADYYCNSYTSSSTWVFGGGTKLTVL

SEQ ID NO: 14782 - protein, 246 aa, Artificial Sequence
  Description of Artificial Sequence: Synthetic polypeptide
  scFv F5 amino acid sequence
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSSGGGGSGGGGSGGGGSQSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVLG

SEQ ID NO: 14783 - protein, 242 aa, Artificial Sequence
  Description of Artificial Sequence: Synthetic polypeptide
  scFv C1 amino acid sequence
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSSGGGGSGGGGSGGGGSETTLTQSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIKR

SEQ ID NO: 14784 - protein, 389 aa, Artificial Sequence
  Description of Artificial Sequence: Synthetic polypeptide
  scHLA-A2
MIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRWALSFYPAEITLTWQRDGEDQTQDTELVETRPAGDGTFQKWAAVVVPSGQEQRYTCHVQHEGLPKPLTLRWE

SEQ ID NO: 14785 - protein, 108 aa, Homo sapiens
DIQMTQSPSSLSASVGDRVTITCRASQWIGILLDWYQQKPGKAPRLLIYYASFLREGVPSRFSGSGSGTDFTLTISSLQPEDFATYYCQQANPAPLTFGQGTKVEIKR

SEQ ID NO: 14786 - protein, 108 aa, Homo sapiens
DIQMTQSPSSLSASVGDRVTITCRASQWIGILLDWYQQKPGKAPKLLIYYASFLAEGVPSRFSGSGSGTDFTLTISSLQPEDFATYYCQQANPAPLTFGQGTKVEIKR

SEQ ID NO: 14787 - protein, 108 aa, Homo sapiens
DIQMTQSPSSLSASVGDRVTITCRASQWIGILLDWYQQKPGKAPKLLIYYASFLNKGVPSRFSGSGSGTDFTLTISSLQPEDFATYYCQQANPAPLTFGQGTKVEIKR

SEQ ID NO: 14788 - protein, 108 aa, Homo sapiens
DIQMTQSPSSLSASVGDRVTITCRASQWIGILLDWYQQKPGKAPKLLIYYASFLRPGVPSRFSGSGSGTDFTLTISSLQPEDFATYYCQQANPAPLTFGQGTKVEIKR

SEQ ID NO: 14789 - protein, 108 aa, Homo sapiens
DIQMTQSPSSLSASVGDRVTITCRASQWIGILLDWYQQKPGKAPKLLIYYASFLPEGVPSRFSGSGSGTDFTLTISSLQPEDFATYYCQQANPAPLTFGQGTKVEIKR

SEQ ID NO: 14790 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPVPTTFGQGTKVEIKR

SEQ ID NO: 14791 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPHPTTFGQGTKVEIKR

SEQ ID NO: 14792 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPVPPTFGQGTKVEIKR

SEQ ID NO: 14793 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPHPPTFGQGTKVEIKR

SEQ ID NO: 14794 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPTPPTFGQGTKVEIKR

SEQ ID NO: 14795 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPLPPTFGQGTKVEIKR

SEQ ID NO: 14796 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPIPPTFGQGTKVEIKR

SEQ ID NO: 14797 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQPANPTPPTFGQGTKVEIKR

SEQ ID NO: 14798 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPVPVTFGQGTKVEIKR

SEQ ID NO: 14799 - protein, 108 aa, Homo sapiens
DIQMTQSPSSLSASVGDRVTITCRASQWIGILLDWYQQKPGKAPKLLIYYASFLNNGVPSRFSGSGSGTDFTLTISNLQPEDFATYYCQQANPAPLTFGQGTKVEIKR

SEQ ID NO: 14800 - protein, 108 aa, Homo sapiens
DIQMTQSPSSLSASVGDRVTITCRASQWIGILLDWYQQKPGKAPKLLIYYASFLAPGVPSRFSGSGSGTDFTLTISSLQPEDFATYYCQQANPAPLTFGQGTKVEIKR

SEQ ID NO: 14801 - protein, 108 aa, Homo sapiens
DIQMTQSPSSLSASVGDRVTITCRASQWIGILLDWYQQKPGKAPKLLIYYASFLNSGVPSRFSGSGSGTDFTLTISSLQPEDFATYYCQQANPAPLTFGQGTKVEIKR

SEQ ID NO: 14802 - protein, 108 aa, Homo sapiens
DIQMTQSPSSLSASVGDRVTITCRASQWIGILLDWYQQKPGKAPELLIYYASFLKQGVPSRFSGSGSGTDFTLTISSLQPEDFATYYCQQANPAPLTFGQGTKVEIKR

SEQ ID NO: 14803 - protein, 108 aa, Homo sapiens
DIQMTQSPSSLSASVGDRVTITCRASQWIGILLDWYQQKPGKAPKLLIYYASFLNNGVPSRFSGSGSGTDFTLTISSLQPEDFATYYCQQANPAPLTFGQGTKVEIKR

SEQ ID NO: 14804 - protein, 108 aa, Homo sapiens
DIQMTQSPSSLSASVGDRVTITCRASQWIGILLDWYQQKPGKAPKLLIYYASFLSPGVPSRFSGSGSGTDFTLTISSLQPEDFATYYCQQANPAPLTFGQGTKVEIKR

SEQ ID NO: 14805 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPTPPTFGQGTKVEIKR

SEQ ID NO: 14806 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQPANPTPPTFGQGTKVEIKR

SEQ ID NO: 14807 - protein, 108 aa, Homo sapiens
DIQMTQSPSSLSASVGDRVTITCRASQWIGILLDWYQQKPGEAPKLLIYYASFLQSGVPSRFSGSGSGTDFTLTISGLQPEDFATYYCQQANPYPTTFGQGTKVEIKR

SEQ ID NO: 14808 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPYPTTFGQGTKVEIKR

SEQ ID NO: 14809 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQPANPHPPTFGQGTKVEIKR

SEQ ID NO: 14810 - protein, 108 aa, Homo sapiens
DIQMTQSPSSLSASVGDRVTITCRASQWIGILVDWYQQKPGKAPKLLIYYASFLPEGVPSRFSGSGSGTDFTLTISSLQPEDFATYYCQQANPAPLTFGQGTKVEIKR

SEQ ID NO: 14811 - protein, 108 aa, Homo sapiens
DIQMTQSPSSLSASVGDRVTITCRASQWIGILVDWYQQKPGKAPKLLIYYASFLQSGVPSRFSGSGSGTDFTLTISSLQPEDFATYYCQQANPVPPTFGQGTKVEIKR

SEQ ID NO: 14812 - protein, 108 aa, Homo sapiens
DIQMTQSPSSLSASVGDRVTITCRASQWIGILIDWYQQKPGKAPKLLIYYASFLPEGVPSRFSGSGSGTDFTLTISSLQPEDFATYYCQQANPAPLTFGQGTKVEIKR

SEQ ID NO: 14813 - protein, 108 aa, Homo sapiens
DIQMTQSPSSLSASVGDRVTITCRASQWIGILIDWYQQKPGKAPKLLIYYASFLQSGVPSRFSGSGSGTDFTLTISSLQPEDFATYYCQQANPVPPTFGQGTKVEIKR

SEQ ID NO: 14814 - protein, 108 aa, Homo sapiens
DIQMTQSPSSLSASVGDRVTITCRASQWIGILLDWYQQKPGKAPKLLIYYASFLPEGVPSRFSGSGSGTDFTLTISSLQPEDFATYYCQQANPVPPTFGQGTKVEIKR

SEQ ID NO: 14815 - protein, 108 aa, Homo sapiens
DIQMTQSPSSLSASVGDRVTITCRASQWIGINLDWYQQKPGKAPKLLIYYASFLPEGVPSRFSGSGSGTDFTLTISSLQPEDFATYYCQQANPAPLTFGQGTKVEIKR

SEQ ID NO: 14816 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCQQANPVPPTFGQGTKVEIKR

SEQ ID NO: 14817 - protein, 108 aa, Homo sapiens
DIQMTQSPSSLSASVGDRVTITCRASQWIGILVDWYQQKPGKAPKLLIYYASFLPEGVPSRFSGSGSGTDFTLTISSLQPEDFATYYCQQANPVPPTFGQGTKVEIKR

SEQ ID NO: 14818 - protein, 108 aa, Homo sapiens
DIQMTQSPSSLSASVGDRVTITCRASQWIGILIDWYQQKPGKAPKLLIYYASFLPEGVPSRFSGSGSGTDFTLTISSLQPEDFATYYCQQANPVPPTFGQGTKVEIKR

SEQ ID NO: 14819 - protein, 108 aa, Homo sapiens
DIQMTQSPSSLSASVGDRVTITCRASQWIGINLDWYQQKPGKAPKLLIYYASFLPEGVPSRFSGSGSGTDFTLTISSLQPEDFATYYCQQANPVPPTFGQGTKVEIKR

SEQ ID NO: 14820 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCLQANPVPPTFGQGTKVEIKR

SEQ ID NO: 14821 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCGQANPVPPTFGQGTKVEIKR

SEQ ID NO: 14822 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCQQANPVPPGFGQGTKVEIKR

SEQ ID NO: 14823 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCQQANPVPVTFGQGTKVEIKR

SEQ ID NO: 14824 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCQQANPVPTTFGQGTKVEIKR

SEQ ID NO: 14825 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCQQANPYPTTFGQGTKVEIKR

SEQ ID NO: 14826 - protein, 108 aa, Homo sapiens
DIQMTQSPSSLSASVGDRVTITCRASQWIGNLLDWYQQKPGKAPKLLIYYASFLQSGVPSRFSGSGSGTDFTLTISSLQPEDFATYYCQQANPAPLTFGQGTKVEIKR

SEQ ID NO: 14827 - protein, 108 aa, Homo sapiens
DIQMTQSPSSLSASVGDRVTITCRASQWIGNLLDWYQQKPGKAPKLLIYYASFLQSGVPSRFSGSGFGTDFTLTISSLQPEDFATYYCQQANPAPLTFGQGTKVEIKR

SEQ ID NO: 14828 - protein, 108 aa, Homo sapiens
DIQMTQSPSSLSASVGDRVTITCRASQWIGNLLDWYQQKPGKAPKLLIYYASFLQSGVPSRFSGSGYGTDFTLTISSLQPEDFATYYCQQANPAPLTFGQGTKVEIKR

SEQ ID NO: 14829 - protein, 108 aa, Homo sapiens
DIQMTQSPSSLSASVGDRVTITCRASQWIGNLLDWYQQKPGKAPKLLIYYASFLQSGVPSRFSGSGWGTDFTLTISSLQPEDFATYYCQQANPAPLTFGQGTKVEIKR

SEQ ID NO: 14830 - protein, 108 aa, Homo sapiens
DIQMTQSPSSLSASVGDRVTITCRASQWIGNLLDWYQQKPGKAPKLLIYYASFLQSGVPSRFSGSGRGTDFTLTISSLQPEDFATYYCQQANPAPLTFGQGTKVEIKR

SEQ ID NO: 14831 - protein, 108 aa, Homo sapiens
DIQMTQSPSSLSASVGDRVTITCRASQWIGNLLDWYQQKPGKAPKLLIYYASFLQSGVPSRFSGSGEGTDFTLTISSLQPEDFATYYCQQANPAPLTFGQGTKVEIKR

SEQ ID NO: 14832 - protein, 108 aa, Homo sapiens
DIQMTQSPSSLSASVGDRVTITCRASQWIGINLDWYQQKPGKAPKLLIYYASFLQSGVPSRFSGSGFGTDFTLTISSLQPEDFATYYCQQANPAPLTFGQGTKVEIKR

SEQ ID NO: 14833 - protein, 108 aa, Homo sapiens
DIQMTQSPSSLSASVGDRVTITCRASQWIGINLDWYQQKPGKAPKLLIYYASFLQSGVPSRFSGSGYGTDFTLTISSLQPEDFATYYCQQANPAPLTFGQGTKVEIKR

SEQ ID NO: 14834 - protein, 108 aa, Homo sapiens
DIQMTQSPSSLSASVGDRVTITCRASQWIGINLDWYQQKPGKAPKLLIYYASFLQSGVPSRFSGSGWGTDFTLTISSLQPEDFATYYCQQANPAPLTFGQGTKVEIKR

SEQ ID NO: 14835 - protein, 108 aa, Homo sapiens
DIQMTQSPSSLSASVGDRVTITCRASQWIGINLDWYQQKPGKAPKLLIYYASFLQSGVPSRFSGSGRGTDFTLTISSLQPEDFATYYCQQANPAPLTFGQGTKVEIKR

SEQ ID NO: 14836 - protein, 108 aa, Homo sapiens
DIQMTQSPSSLSASVGDRVTITCRASQWIGINLDWYQQKPGKAPKLLIYYASFLQSGVPSRFSGSGEGTDFTLTISSLQPEDFATYYCQQANPAPLTFGQGTKVEIKR

SEQ ID NO: 14837 - protein, 108 aa, Homo sapiens
DIQMTQSPSSLSASVGDRVTITCRASQYIGNLLDWYQQKPGKAPKLLIYYASFLQSGVPSRFSGSGYGTDFTLTISSLQPEDFATYYCQQANPAPLTFGQGTKVEIKR

SEQ ID NO: 14838 - protein, 108 aa, Homo sapiens
DIQMTQSPSSLSASVGDRVTITCRASQHIGNLLDWYQQKPGKAPKLLIYYASFLQSGVPSRFSGSGYGTDFTLTISSLQPEDFATYYCQQANPAPLTFGQGTKVEIKR

SEQ ID NO: 14839 - protein, 108 aa, Homo sapiens
DIQMTQSPSSLSASVGDRVTITCRASQQIGNLLDWYQQKPGKAPKLLIYYASFLQSGVPSRFSGSGYGTDFTLTISSLQPEDFATYYCQQANPAPLTFGQGTKVEIKR

SEQ ID NO: 14840 - protein, 108 aa, Homo sapiens
DIQMTQSPSSLSASVGDRVTITCRASQNIGNLLDWYQQKPGKAPKLLIYYASFLQSGVPSRFSGSGYGTDFTLTISSLQPEDFATYYCQQANPAPLTFGQGTKVEIKR

SEQ ID NO: 14841 - protein, 108 aa, Homo sapiens
DIQMTQSPSSLSASVGDRVTITCRASQYIGINLDWYQQKPGKAPKLLIYYASFLQSGVPSRFSGSGYGTDFTLTISSLQPEDFATYYCQQANPAPLTFGQGTKVEIKR

SEQ ID NO: 14842 - protein, 108 aa, Homo sapiens
DIQMTQSPSSLSASVGDRVTITCRASQHIGINLDWYQQKPGKAPKLLIYYASFLQSGVPSRFSGSGYGTDFTLTISSLQPEDFATYYCQQANPAPLTFGQGTKVEIKR

SEQ ID NO: 14843 - protein, 108 aa, Homo sapiens
DIQMTQSPSSLSASVGDRVTITCRASQQIGINLDWYQQKPGKAPKLLIYYASFLQSGVPSRFSGSGYGTDFTLTISSLQPEDFATYYCQQANPAPLTFGQGTKVEIKR

SEQ ID NO: 14844 - protein, 108 aa, Homo sapiens
DIQMTQSPSSLSASVGDRVTITCRASQNIGINLDWYQQKPGKAPKLLIYYASFLQSGVPSRFSGSGYGTDFTLTISSLQPEDFATYYCQQANPAPLTFGQGTKVEIKR

SEQ ID NO: 14845 - protein, 108 aa, Homo sapiens
DIQMTQSPSSLSASVGDRVTITCRASQWIGNNLDWYQQKPGKAPKLLIYYASFLQSGVPSRFSGSGYGTDFTLTISSLQPEDFATYYCQQANPAPLTFGQGTKVEIKR

SEQ ID NO: 14846 - protein, 108 aa, Homo sapiens
DIQMTQSPSSLSASVGDRVTITCRASQWIGTLLDWYQQKPGKAPKLLIYYASFLQSGVPSRFSGSGYGTDFTLTISSLQPEDFATYYCQQANPAPLTFGQGTKVEIKR

SEQ ID NO: 14847 - protein, 108 aa, Homo sapiens
DIQMTQSPSSLSASVGDRVTITCRASQWIGIQLDWYQQKPGKAPKLLIYYASFLQSGVPSRFSGSGYGTDFTLTISSLQPEDFATYYCQQANPAPLTFGQGTKVEIKR

SEQ ID NO: 14848 - protein, 108 aa, Homo sapiens
DIQMTQSPSSLSASVGDRVTITCRASQWIGITLDWYQQKPGKAPKLLIYYASFLQSGVPSRFSGSGYGTDFTLTISSLQPEDFATYYCQQANPAPLTFGQGTKVEIKR

SEQ ID NO: 14849 - protein, 108 aa, Homo sapiens
DIQMTQSPSSLSASVGDRVTITCRASQWIGNLLDWYQQKPGKAPKLLIYYASFLQSGVPSRFSGSGYGTDFTLTISSLQPEDFATYYCQQANPVPPTFGQGTKVEIKR

SEQ ID NO: 14850 - protein, 108 aa, Homo sapiens
DIQMTQSPSSLSASVGDRVTITCRASQYIGNLLDWYQQKPGKAPKLLIYYASFLQSGVPSRFSGSGYGTDFTLTISSLQPEDFATYYCQQANPVPPTFGQGTKVEIKR

SEQ ID NO: 14851 - protein, 108 aa, Homo sapiens
DIQMTQSPSSLSASVGDRVTITCRASQHIGNLLDWYQQKPGKAPKLLIYYASFLQSGVPSRFSGSGYGTDFTLTISSLQPEDFATYYCQQANPVPPTFGQGTKVEIKR

SEQ ID NO: 14852 - protein, 108 aa, Homo sapiens
DIQMTQSPSSLSASVGDRVTITCRASQWIGINLDWYQQKPGKAPKLLIYYASFLQSGVPSRFSGSGYGTDFTLTISSLQPEDFATYYCQQANPVPPTFGQGTKVEIKR

SEQ ID NO: 14853 - protein, 108 aa, Homo sapiens
DIQMTQSPSSLSASVGDRVTITCRASQYIGINLDWYQQKPGKAPKLLIYYASFLQSGVPSRFSGSGYGTDFTLTISSLQPEDFATYYCQQANPVPPTFGQGTKVEIKR

SEQ ID NO: 14854 - protein, 108 aa, Homo sapiens
DIQMTQSPSSLSASVGDRVTITCRASQWIGNNLDWYQQKPGKAPKLLIYYASFLQSGVPSRFSGSGYGTDFTLTISSLQPEDFATYYCQQANPVPPTFGQGTKVEIKR

SEQ ID NO: 14855 - protein, 108 aa, Homo sapiens
DIQMTQSPSSLSASVGDRVTITCRASQWIGNLLDWYQQKPGKAPKLLIYYASFLQSGVPSRFSGSGYGTDFTLTISSLQPEDFATYYCQQANPTPPTFGQGTKVEIKR

SEQ ID NO: 14856 - protein, 108 aa, Homo sapiens
DIQMTQSPSSLSASVGDRVTITCRASQYIGNLLDWYQQKPGKAPKLLIYYASFLQSGVPSRFSGSGYGTDFTLTISSLQPEDFATYYCQQANPTPPTFGQGTKVEIKR

SEQ ID NO: 14857 - protein, 108 aa, Homo sapiens
DIQMTQSPSSLSASVGDRVTITCRASQHIGNLLDWYQQKPGKAPKLLIYYASFLQSGVPSRFSGSGYGTDFTLTISSLQPEDFATYYCQQANPTPPTFGQGTKVEIKR

SEQ ID NO: 14858 - protein, 108 aa, Homo sapiens
DIQMTQSPSSLSASVGDRVTITCRASQWIGINLDWYQQKPGKAPKLLIYYASFLQSGVPSRFSGSGYGTDFTLTISSLQPEDFATYYCQQANPTPPTFGQGTKVEIKR

SEQ ID NO: 14859 - protein, 108 aa, Homo sapiens
DIQMTQSPSSLSASVGDRVTITCRASQYIGINLDWYQQKPGKAPKLLIYYASFLQSGVPSRFSGSGYGTDFTLTISSLQPEDFATYYCQQANPTPPTFGQGTKVEIKR

SEQ ID NO: 14860 - protein, 108 aa, Homo sapiens
DIQMTQSPSSLSASVGDRVTITCRASQHIGINLDWYQQKPGKAPKLLIYYASFLQSGVPSRFSGSGYGTDFTLTISSLQPEDFATYYCQQANPTPPTFGQGTKVEIKR

SEQ ID NO: 14861 - protein, 108 aa, Homo sapiens
DIQMTQSPSSLSASVGDRVTITCRASQWIGNNLDWYQQKPGKAPKLLIYYASFLQSGVPSRFSGSGYGTDFTLTISSLQPEDFATYYCQQANPTPPTFGQGTKVEIKR

SEQ ID NO: 14862 - protein, 108 aa, Homo sapiens
DIQMTQSPSSLSASVGDRVTITCRASQWIGNLLDWYQQKPGKAPKLLIYYASFLQSGVPSRFSGSGFGTDFTLTISSLQPEDFATYYCQQANPVPPTFGQGTKVEIKR

SEQ ID NO: 14863 - protein, 108 aa, Homo sapiens
DIQMTQSPSSLSASVGDRVTITCRASQWIGNLLDWYQQKPGKAPKLLIYYASFLPEGVPSRFSGSGFGTDFTLTISSLQPEDFATYYCQQANPVPPTFGQGTKVEIKR

SEQ ID NO: 14864 - protein, 108 aa, Homo sapiens
DIQMTQSPSSLSASVGDRVTITCRASQWIGILVDWYQQKPGKAPKLLIYYASFLQSGVPSRFSGSGFGTDFTLTISSLHPEDFATYYCQQANPAPLTFGQGTKVEIKR

SEQ ID NO: 14865 - protein, 108 aa, Homo sapiens
DIQMTQSPTSLSASVGDRVTITCRASQWIGNLLDWYQQKPGKAPKLLIYYASFLQSGVPSRFSGGGFGTDFTLTISSLQPEDFATYYCQQANPAPLTFGQGTKVEIKR

SEQ ID NO: 14866 - protein, 115 aa, Unknown; identical to SEQ ID NO: 10875
  Description of Unknown: Camelid sequence

SEQ ID NO: 14867 - protein, 115 aa, Unknown; identical to SEQ ID NO: 10876
  Description of Unknown: Camelid sequence

SEQ ID NO: 14868 - protein, 114 aa, Unknown; identical to SEQ ID NO: 10877
  Description of Unknown: Camelid sequence

SEQ ID NO: 14869 - protein, 114 aa, Unknown; identical to SEQ ID NO: 10878
  Description of Unknown: Camelid sequence

SEQ ID NO: 14870 - protein, 128 aa, Unknown; identical to SEQ ID NO: 10893
  Description of Unknown: Camelid sequence

SEQ ID NO: 14871 - protein, 124 aa, Unknown; identical to SEQ ID NO: 10894
  Description of Unknown: Camelid sequence

SEQ ID NO: 14872 - protein, 120 aa, Unknown; identical to SEQ ID NO: 10895
  Description of Unknown: Camelid sequence

SEQ ID NO: 14873 - protein, 123 aa, Unknown; identical to SEQ ID NO: 10896
  Description of Unknown: Camelid sequence

SEQ ID NO: 14874 - protein, 125 aa, Homo sapiens; identical to SEQ ID NO: 10897

SEQ ID NO: 14875 - protein, 125 aa, Homo sapiens; identical to SEQ ID NO: 10898

SEQ ID NO: 14876 - protein, 124 aa, Unknown; identical to SEQ ID NO: 10899
  Description of Unknown: Camelid sequence

SEQ ID NO: 14877 - protein, 131 aa, Homo sapiens; identical to SEQ ID NO: 10900

SEQ ID NO: 14878 - protein, 126 aa, Homo sapiens; identical to SEQ ID NO: 10901

SEQ ID NO: 14879 - protein, 128 aa, Homo sapiens; identical to SEQ ID NO: 10902

SEQ ID NO: 14880 - protein, 120 aa, Unknown; identical to SEQ ID NO: 10903
  Description of Unknown: Camelid sequence

SEQ ID NO: 14881 - protein, 123 aa, Unknown; identical to SEQ ID NO: 10904
  Description of Unknown: Camelid sequence

SEQ ID NO: 14882 - protein, 125 aa, Unknown; identical to SEQ ID NO: 10905
  Description of Unknown: Camelid sequence

SEQ ID NO: 14883 - protein, 116 aa, Homo sapiens
EVQLLESGGGLVQPGGSLRLSCAASGFTFKAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 14884 - protein, 108 aa, Homo sapiens
DIQMTQSPSSLSASVGDRVTITCRASQYIGAELSWYQQKPGKAPKLLIYWISELQSGVPSRFSGSGSGTDFTLTISSLQPEDFATYYCQQSSNTPYTFGQGTKVEIKR

SEQ ID NO: 14885 - protein, 108 aa, Homo sapiens
DIQMTQSPSSLSASVGDRVTITCRASQYIGINLIWYQQKPGKAPKLLIYWASVLQSGVPSRFSGSGSGTDFTLTISSLQPEDFATYYCQQSVYDPPTYGQGTKVEIKR

SEQ ID NO: 14886 - protein, 108 aa, Homo sapiens
DIQMTQSPSSLSASVGDRVTITCRASQDIFWLLSWYQQKPGKAPTLLIYSTSILQSGVPSRFSGSGSGTDFTLTISSLQPEDFATYYCQQYYLDPPTFSQGTKVEIKR

SEQ ID NO: 14887 - protein, 108 aa, Homo sapiens
DIQMTQSPSSLSASVGDRVTITCRASQFIGVNLNWYQQKPGKAPRLLIYLSSILQSGVPSRFSGSGSGTDFTLTISSLQPEDFATYYCQQTYDIPTTFGQGTKVEIKR

SEQ ID NO: 14888 - protein, 108 aa, Homo sapiens
DIQMTQSPSSLSASVGDRVTITCRASQNIGINLQWYQQKPRKAPKLLIYYASILQSGVPSRFSGSGSGTDFTLTISSLQPEDFATYYCQQDYDTPFTFGQGTKVEIKR

SEQ ID NO: 14889 - protein, 108 aa, Homo sapiens
DIQMTQFPSSLSASVGDRVTITCRASQHIERWLNWYQQKPGKAPKLLIYRSSYLQSGVPSRFSGSGSGTDFTLTISSLQPEDFATYYCQQDAILPHTFGQGTKVEIKR

SEQ ID NO: 14890 - protein, 108 aa, Homo sapiens
DIQMTQSPSSLSASVGDRVTITCRASQGIGVNLQWYQQKPGKAPKLLIYFSSVLQSGVPSRFSGSGSGTDFTLTISSLQPEDFATYYCQQDFDFPQTFGQGTKVEIKR

SEQ ID NO: 14891 - protein, 108 aa, Homo sapiens
DIQMTQSPSSLSASVGDRVTITCRASQNIGINLQWYQQKPRKAPKLLIYYASILQSGVPSRFSGSGSGTDFTLTISSLQPEDFATYYCQQEYDYPNTFGQGTKVEIKR

SEQ ID NO: 14892 - protein, 108 aa, Homo sapiens
DIQMTQSPSSLSASVGDRVTITCRASSSIGSGLEWYQQKPGKAPKLLIVGWSGLQSGVPSRFSGSGSGTDFTLTISSLQPEDFATYYCRQCVGLPCTFGQGTKVEIKR

SEQ ID NO: 14893 - protein, 108 aa, Homo sapiens
DIQMTQSPSSLSASVGDRVTITCRASQWIGVELSWYQQKPGKAPKLLIYWGSELQSGVPSRFSGSGSGTDFTLTISSLQPEDFATYYCQQLALPPFTFGQGTKVEIKR

SEQ ID NO: 14894 - protein, 108 aa, Homo sapiens
DIQMTQSPSSLSASVGDRVTITCRASHDIGVSLDWYQQKPGKAPKLLIVWASVLQSGVPSRFSGSGSGTDFTLTISSLQPEDFATYYCLQVGAGPMTFGQGTKVEIKR

SEQ ID NO: 14895 - protein, 108 aa, Homo sapiens
DIQMTQSPSSLSASVGDGVTITCRASQYIGIDLAWYQRKPGKAPRLLIYKASALQSGVPSRFSGSGSGTDFTLTISSLQPEDFATYYCQQYADYPATFGQGTKVEIKR

SEQ ID NO: 14896 - protein, 108 aa, Homo sapiens
DIQMTQSPSSLSASVGDRVTITCRASQEIEHYLSWYQQKPGKAPKLLIYLSSRLQSGVPSRFSGSGSGTDFTLTISSLQPEDFATYYCQQNVQLPITFGQGTKVEIKR

SEQ ID NO: 14897 - protein, 108 aa, Homo sapiens
DIQMTQSPSSLSASVGDRVTITCRASQEIGVSLSWYQQKPGKAPKLLIYWGSELQSGVPSRFSGSGSGTDFTLTISSLQPEDFATYYCQQDHNWPMTFGQGTKVEIKR

SEQ ID NO: 14898 - protein, 108 aa, Homo sapiens
DIQMTQSPSSLSASVGDRVTITCRASALIMGDLDWYQQKPGKAPKLLIAGVSFLQSGVPSRFSGSGSGTDFTLTISSLQPEDFATYYCAQSRSWPYTFGQGTKVEIKR

SEQ ID NO: 14899 - protein, 108 aa, Homo sapiens
DIQMTQSPSSLSASVGDRVTITCRASKMIDENLAWYQQKPGKAPKLLILRSSGLQSGVPSRFSGSGSGTDFTLTISSLQPEDFATYYCHQGHSAPGTFGQGTKVEIKR

SEQ ID NO: 14900 - protein, 108 aa, Homo sapiens
DIQMTQSPSSLSASVGDRVTITCRASRYIGVSLDWYQQKPGKAPKLLIMWGSALQSGVPSRFSGSGSGTDFTLTISSLQPEDFATYYCLQSAAPPATFGQGTKVEIKR

SEQ ID NO: 14901 - protein, 108 aa, Homo sapiens
DIQMTQSPSSLSASVGDRVTITCRASQEIGVSLSWYQQKPGKAPKLLIYWASALQSGVPSRFSGSGSGTDFTLTISSLQPEDFATYYCQQSYLPPDTFGQGTKVEIKR

SEQ ID NO: 14902 - protein, 108 aa, Homo sapiens
DIQMTQSPSSLSASVGDRVTITCRASQEIASDLLWYQQKPGKAPKLLIYNGSSLQSGVPSRFSGSGSGTDFTLTISRLQPEDFATYYCQWLWSEPLTFGQGTKVEIKR

SEQ ID NO: 14903 - protein, 108 aa, Homo sapiens
DIQMTQSPSSLSASVGDRVTITCRASQHIGDALWWYQQKPGKAPKLLIYWTSNLQSGVPSRFSGSGSGTDFTLTISSLQPEDFATYYCQQTIRRPYTFGQGTKVKIKR

SEQ ID NO: 14904 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPAPLTFGQGTKVEIKR

SEQ ID NO: 14905 - protein, 108 aa, Homo sapiens
DIQMTQSPSSLSASVGDRVTITCRASQNIGINLQWYQQKPRKAPKLLIYYASILQSGVPSRFSGSGSGTDFTLTISSLQPEDFATYYCQQSYDLPKTFGQGTKVEIKR

SEQ ID NO: 14906 - protein, 108 aa, Homo sapiens
DIQMIQSPSSLSASVGDRVTITCRASQEIGVSLSWYQQKPGKAPKLLIYWGSELQSGVPSRFSGSGSGTDFTLTISSLQPEDFATYYCQQWYGWPDTFGQGTKVGIKR

SEQ ID NO: 14907 - protein, 108 aa, Homo sapiens
DIQMTQSPSSLSASVGDRVTITCRASQHIGIELNWYQQKPGKAPKLLIYWASVLQSGVPSRFSGSGSGTDFTLTISSLQPEDFATYYCQQSVYVPTTFGQGTKVEIKR

SEQ ID NO: 14908 - protein, 108 aa, Homo sapiens
DIQMTQSPSSLSASVGDRVTITCRASQWIGAELVWYQQKPGKAPKLLIYWSSVLQSGVPSRFSGSGSGTDFTLTISSLQPEDFATYYCQQAAHSPPTFGQGTKVEIKR

SEQ ID NO: 14909 - protein, 108 aa, Homo sapiens
DIQMTQSPSSLSASVGDRVTITCRASQDISRSLAWYQRKPGKAPRLLIYMSSTLQSGVPSRFSGSGSGTDFTLTISSLQPEDFATYYCQQYDSYPSTFGQGTKVEIKR

SEQ ID NO: 14910 - protein, 108 aa, Homo sapiens
DIQMTQSPSSLSASVGDRVTITCRASRMIGGMLLWYQQKPGKAPKLLITYGSVLQSGVPSRFSGSGSGTDFTLTISSLQPEDFATYYCAQEFWWPHTFGQGTKVEIKR

SEQ ID NO: 14911 - protein, 108 aa, Homo sapiens
DIQMTQSPSSLSASVGDRVTITCRASRPIGDRLTWYQQKPGKAPKLLISWVSVLQSGVPSRFSGSGSGTDFTLTISSLQPEDFATYYCRQLGGGPFTFGQGTKVEIKR

SEQ ID NO: 14912 - protein, 108 aa, Homo sapiens
DIQMTQSPSSLSASVGDRVTITCRASQYIGVSLSWYQQKPGKAPKLLIYFASALQSGVPSRFSGSGSGTDFTLTISSLQPEDFATYYCQQDRDWPATFGQGTKVEIKR

SEQ ID NO: 14913 - protein, 108 aa, Homo sapiens
DIQMTQSPSSLSASVGDRVTITCRASGAIGDRLKWYQQKPGKAPKLLISWASVLQSGVPSRFSGSGSGTDFTLTISSLQPEDFATYYCVQGPGVPLTFGQGTKVEIKR

SEQ ID NO: 14914 - protein, 108 aa, Homo sapiens
DIQMTQSPSSLSASVGDRVTITCRASQPIARWLAWYQQKPGKAPKLLIYGSSVLQSGVPSRFSGSGSGTDFTLTISSLQPEDFATYYCQQDLRLPPTFGQGTKVEIKR

SEQ ID NO: 14915 - protein, 108 aa, Homo sapiens
DIQMTQSPSSLSASVGDRVTITCRASQNIGVSLSWYQQKPGKAPRLLIYYGSNLLSGVPSRFSGSGSGTDFTLTISSLQPEDFATYYCQQEFSWPVTFGQGTKVEIKR

SEQ ID NO: 14916 - protein, 108 aa, Homo sapiens
DIQMTQSPSSLSASVGDRVTITCRASLPIDDGLGWYQQKPGKAPKLLICGVSGLQSGVPLRFSGSGSGTDFTLTISSLQPEDFATYYCGQGQVQPSTFGQGTKVEIKR

SEQ ID NO: 14917 - protein, 108 aa, Homo sapiens
DIQMTQSPSSLSASVGDRVTITCRASQNIGINLQWYQQKPRKAPKLLIYYASILQSGVPSRFSGSGSGTDFTLTISSLQPEDFATYYCQQSYDAPTTFGQGTKVEIKR

SEQ ID NO: 14918 - protein, 108 aa, Homo sapiens
DIQMTQSPSSLSASVGDRVTITCRASQSIGVNLMWYQQKPGKAPKLLIYFASILQSGVPSRFSGSGSGTDFTLTISSLQPEDFATYYCQQNYDIPKTFGQGTKVEIKR

SEQ ID NO: 14919 - protein, 108 aa, Homo sapiens
DIQMTQSPSSLSASVGDRVTITCRASQWIGISLSWYQQKPGKAPKLLIYYGSVLQSGVPSRFSGSGSGTDFTLTISSLQPEDFATYYCQQSHDLPVTFGQGTKVEIKR

SEQ ID NO: 14920 - protein, 108 aa, Homo sapiens
DIQMTQSPSSLSASVGDRVTITCRASQWIGVSLSWYQQKPGKAPKLLIYYASILQSGVPSRFSGSGSGTDFTLTISSLQPEDFATYYCQQEMSYPPTFGQGTKVEIKR

SEQ ID NO: 14921 - protein, 108 aa, Homo sapiens
DIQMTQSPSSLSASVGDRVTITCRASQDIGVSLEWYQQKPGKAPKLLIYWSSALQSGVPSRFSGSGSGTDFTLTISSLQPEDLATYYCQQGHTYPSTFGQGTKVEIKR

SEQ ID NO: 14922 - protein, 108 aa, Homo sapiens
DIQMTQSPSSLSASVGDRVTITCRASQYIGVYLSWYQQKPGKAPKLLIYWASLLQSGVPSRFSGSGSGTDFTLTISSLQPEDFATYYCQQTVRDPITFGQGTKVEIKR

SEQ ID NO: 14923 - protein, 108 aa, Homo sapiens
DIQMTQSPSFLSASVGDRVTITCRASQSIYTMLNWYQQKPGKAPKLLIYRASYLQSGVPSRFSGSGSGTDFTLTISSLLPEDSATYYCQQDFSYPSTFGQGTKVEIKR

SEQ ID NO: 14924 - protein, 108 aa, Homo sapiens
DIQMTQSPSSLSASVGDRVTITCRASQYIGANLSWYQQKPGKAPKLLIYYISVLQSGVPSRFSGSGSGTDFTLTISSLQPEDFATYYCQQELYTPHTFGQGTKVEIKR

SEQ ID NO: 14925 - protein, 108 aa, Homo sapiens
DIQLTQSPSSLSASVGDRVTITCRASQYIGVTLMWYQQKPGKAPKLLIYYASQLQSGVPSRFSGSGSGTDFTLTISSLQPEDFATYYCQQEVSYPYTFGQGTKVEIKR

SEQ ID NO: 14926 - protein, 108 aa, Homo sapiens
DIQMTQSPSSLSASVGDRVTITCRASQHIGVSLTWYQQKPGKAPKLLIYFASILQSGVPSRFSGSGSGTDFTLTISSLQPEDYATYYCQQDMSYPPTFGQGTKVGIKR

SEQ ID NO: 14927 - protein, 108 aa, Homo sapiens
DIQMTQSPSSLSASVGDRVTITCRASQDIGISLEWYQQKPGKAPKLLIYFASQLQSGVPSRFSGSGSGTDFTLTISSLQPEDFATYYCQQVYDFPNTFGQGTKVEIKR

SEQ ID NO: 14928 - protein, 108 aa, Homo sapiens
DIQMTQSPSSLSASVGDRVTITCRASQHIGVSLNWYQQKPGKVPKLLIYWASILQSGVPSRFSGSGSGTDFTLTISSLQPEDFATYYCQQEHTIPSTFGQGTKVEIKR

SEQ ID NO: 14929 - protein, 108 aa, Homo sapiens
DIQMTQSPSSLSASVGDRVTITCRASQHIGVSLDWYQQKPGKAPKLLIYYGSELQSGVPSRFSGSGSGTDFTLTISSLQPEDFATYYCQQYVTHPTTFGQGTKVEIKR

SEQ ID NO: 14930 - protein, 108 aa, Homo sapiens
DIQMTQSPSSLSASVGDRVTITCRASQRIGMMLDWYQQKPGKAPKLLIYGGSKLQSGVPSRFSGSGSGTDFTLTISSLQPEDFATYYCQHRGWYPLTFGQGTKVEIKR

SEQ ID NO: 14931 - protein, 108 aa, Homo sapiens
DIQMTQSPSSLSASVGDRVTITCRASQPIGDRLSWYQQKPGKAPKLLIYFSSVLQSGVPSRFSGSGSGTDFTLTISSLQPEDFATYYCQQHGLRPDTFGQGTKVEIKR

SEQ ID NO: 14932 - protein, 108 aa, Homo sapiens
DIQMTQSPSSLSASVGDRVTITCRASQWIGSSLMWYQQKPGKAPKLLIYWASELQSGVPSRFSGSGSGTDFTLTISSLQPEDFATYYCQQEYSYPSTFGQGTKVEIKR

SEQ ID NO: 14933 - protein, 108 aa, Homo sapiens
DIQMTQSPSSLSASVGDRVTITCRASQDIGVSLAWYQQKPGKAPKLLIYFGSVSLSGVPSRFSGSGSGTDFTLTISSLQPEDFATYYCQQSHLPPTTFGQGTKVEIKR

SEQ ID NO: 14934 - protein, 108 aa, Homo sapiens
DIQMTQSPSSLSASVGDRVTITCRASQWIGVELNWYQQKPGKAPKLLIYWTSILQSGVPSRFSGSGSGTDFTLTISSLQPEDFATYYCQQVINSPYTFGQGTKVEIKR

SEQ ID NO: 14935 - protein, 108 aa, Homo sapiens
DIQMTQSPSSLSASVGDRVTITCRASQDIGKWLEWYQQKPGKAPKLLIGATSWLQSGVPSRFSGSGSGTDFTLTISSLQPEDFATYYCVQQGRRPGTFGQGTKVEIKR

SEQ ID NO: 14936 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQRSDLSPLTFGQGTKVEIKR

SEQ ID NO: 14937 - protein, 108 aa, Homo sapiens
DIQMTQSPSSLSASVGDRVTITCRASQNIYMNLEWYQQKPGKAPKLLIVFGSWLQSGVPSRFSGSGSGTDFTLTISSLQPEDFATYYCRQTEAPPSTFGQGTKVEIKR

SEQ ID NO: 14938 - protein, 108 aa, Homo sapiens
DIRMTQSPSSLSASVGDRVTITCRASQHIGSSLSWYQQKPGKAPKLLIYYASVLQSGVPSRFSGSGSGTDFTLTISSLQPEDFATYYCQQEYSWPPTLGQGTKVEIKR

SEQ ID NO: 14939 - protein, 108 aa, Homo sapiens
DIQMTQSPSSLSASVGDRVTITCRASQDIRTLLRWYQQKPGKAPKLLIYWSSELQSGVPSRFSGSGSGTDFTLTISSLQPEDFATYYCQQTFHAPNTFGQGTKVEIKR

SEQ ID NO: 14940 - protein, 108 aa, Homo sapiens
DIRMTQSPSSLSASVGDRVTITCRASQYIGKYLSWYQQKPGKAPKLLIYLSSTLQSGVPSRFSGSGSGTDFTLTISSLQPEDFATYYCQQNDRLPLTLGQGTKVEIKR

SEQ ID NO: 14941 - protein, 108 aa, Homo sapiens
DIQMTQSPSSLSASVGDRVTITCQASQLIGNMLSWYQQKPGKAPTLLIYIGSSLQSGVPSRFSGSGSGTDFTLTISSLQPEDFATYYCQQTYFDPPTFGQGTKVEIKR

SEQ ID NO: 14942 - protein, 108 aa, Homo sapiens
DIQMTQSPSSLSASVGDRVTITCRASQYIGINLRWYQQKPGKAPKLLIYYSSTLLSGVPSRFSGSGSGTDFTLTISSLQPEDFATYYCQQSYDSPVTFGQGTKVEIKR

SEQ ID NO: 14943 - protein, 108 aa, Homo sapiens
DIQMTQSPSSLSASVGDRVTITCRASWAIGDRLEWYQQKPGKAPKLLIAWGSVLQSGVPSRFSGSGSGTDFTLTISSLQPEDFATYYCSQLGSRPRTFGQGTKVEIKR

SEQ ID NO: 14944 - protein, 108 aa, Homo sapiens
DIQMTQSPSSLSASVGDRVTITCRASQSIDNWLAWYQQKPGEAPKLLIYGTSRLQSGVPSRFSGSGSGTDFTLTISSLQPEDFATYYCQQYNFFPSTFGQGTKVEIKR

SEQ ID NO: 14945 - protein, 108 aa, Homo sapiens
DIQMTQSPSSLSASVGDRVTITCRASTFIGNVLNWYQQKPGKAPKLLISYVSMLQSGVPSRFSGSGSGTDFTLTISSLQPEDFATYYCCQSYDVPFTFGQGTQVEIKR

SEQ ID NO: 14946 - protein, 108 aa, Homo sapiens
DIQMTQSPSSLSASVGDRVTITCRASQWIGVSLVWYQQKPGKAPKLLIYWASVLQSGVPSRFSGSGSGTDFTLTISSLQPEDFATYYCQQTHAGPHTFGQGTKVEIKR

SEQ ID NO: 14947 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQSSVDPLTFGQGTKVEIKR

SEQ ID NO: 14948 - protein, 108 aa, Homo sapiens
DIQMTQSPSSLSASVGDRVTITCRASQDIGVSLRWYQQKPGKAPKLLIYWASELQSGVPSRFSGSGSGTDFTLTISSLQPEDFATYYCQQLYDYPPTFGQGTKVEIKR

SEQ ID NO: 14949 - protein, 108 aa, Homo sapiens
DIQMTQSPSSLSASVGDRVTITCRASRFIASGLDWYQQKPGKAPKLLISRFSGLQSGVPSRFSGSGSGTDFTLTISSLQPEDFATYYCKQGFGAPATFGQGTKVEIKR

SEQ ID NO: 14950 - protein, 109 aa, Homo sapiens
DIQMTQSPSSLSASVGDRVTITCRASQYISTELEWYQQKPGKAPKLLIYSSSMLQSGVPSRFSGSGSGTDFTLTISSLQPEDFATYYCQQSASALPLTFGQGTKVEIKR

SEQ ID NO: 14951 - protein, 108 aa, Homo sapiens
DIQMTQSPSSLSASVGDRVTITCRASQWIGASLQWYQQKPGQAPKLLIYYMSVLQSGVPSRFSGSGSGTDFTLTISSLQPEDFATYYCQQTALTPATFGQGTKVEIKR

SEQ ID NO: 14952 - protein, 108 aa, Homo sapiens
DIQMTQSPSSLSASVGDRVTITCRASQVIGDYLSWYQQKPGKAPKLLIYFRSVLQSGVPSRFSGSGSGTDFTLTISSLQPEDFATYYCQQNWNLPVTFGQGTKVEIKR

SEQ ID NO: 14953 - protein, 108 aa, Homo sapiens
DIQMTQSPSSLSASVGDRVTITCRASQYIGVNLSWYQQKPGKAPKLLIYYVSVLQSGVPSRFSGSGSGTDFTLTISSLQPEDFATYYCQQTYDIPSTFGQGTKVEIKR

SEQ ID NO: 14954 - protein, 108 aa, Homo sapiens
DIQMTQSPSTLSASVGDRVTITCRASQWIGVSLSWYQQKPGKAPKLLIYYTSYLQSGVPSRFSGSGSGTDFTLTISSLQPEDFATYYCQQETTWPYTFGQGTKVEIKR

SEQ ID NO: 14955 - protein, 108 aa, Homo sapiens
DIQMTQSPSSLSASVGDRVTITCRASQYIGAELNWYQQKPGKAPKLLIYWTSVLQSGVPSRFSGSGSGTDFTLTISSLQPEDFATYYCQQAILAPLTFGQGTKVEIKR

SEQ ID NO: 14956 - protein, 108 aa, Homo sapiens
DIQMTQSPSSLSASVGDRVTITCRASQWIGVSLNWYQQKPGKAPKLLIYFASVLQSGVPSRFSGSGSGTDFTLTISSLQPEDFATYYCQQNAFYPDTFGQGTKVEIKR

SEQ ID NO: 14957 - protein, 108 aa, Homo sapiens
DIQMTQSPSSLSASVGDRVTITCRASQWIGAELNWYQQKPGKAPKLLIYWMSVLQSGVPSRFSGSGSGTDFTLTISSLQPEDFATYYCQQTSFFPITFGQGTKVEIKR

SEQ ID NO: 14958 - protein, 108 aa, Homo sapiens
DIQMTQSPSSLSASVGDRVAITCRASQDIRTLLAWYQQKPGKAPMLLIYWASELQSGVPSRFSGSGSGTDFTLTISSLQPEDFATYYCQQSLSWPSTFGQGTKVEIKR

SEQ ID NO: 14959 - protein, 108 aa, Homo sapiens
DIQMTQSPSSLSASVGDRVTITCRASQYIGVSLDWYQQKPGKAPKLLIYYSSMLQSGVPSRFSGSGSGTDFTLTISSLQPEDFATYYCQQYYTVPDTFGQGTKVEIKR

SEQ ID NO: 14960 - protein, 108 aa, Homo sapiens
DIQMTQSPSSLSASVGDRVTITCRASWPIGDRLNWYQQKPGKAPKLLIAWVSVLQSGVPSRFSGSGSGTDFTLTISSLQPEDFATYYCGQLGGGPRTFGQGTKVEIKR

SEQ ID NO: 14961 - protein, 108 aa, Homo sapiens
DIQMTQSPSSLSASVGDRVSITCRASQFIGWELAWYQQKPGKAPMLLIYPYSTLQSGVPSRFSGSGSGTDFTLTISSLQPEDFATYYCQQLAGFPYTFGQGTKVEIKR

SEQ ID NO: 14962 - protein, 108 aa, Homo sapiens
DIQMTQSPSSLSASVGDRVTITCRASQPIGDRLSWYQQKPGKAPKLLIYFVSQLQSGVPSRFSGSGSGTDFTLTISSLQPEDFATYYCQQSHPNPKTFGQGTKVEIKR

SEQ ID NO: 14963 - protein, 108 aa, Homo sapiens
DIQMTQSPSSLSASVGDGVTITCRASQWIGVELSWYQQKPGKAPKLLIYWGSELQSGVPSRFSGSGSGTDFTLTISSLQPEDFATYYCQQLALPPFTFGQGTKVEIKR

SEQ ID NO: 14964 - protein, 108 aa, Homo sapiens
DIQMTQSPSSLSASVGDRVTITCRASQEIGASLEWYQQKPGKAPKLLIYWASVLQSGVPSRFSGSGSGTDFTLTISSLQPEDFATYYCQQMHHTPFTFGQGTKVEIKR

SEQ ID NO: 14965 - protein, 108 aa, Homo sapiens
DIQMTQSPSSLSASVGDRVTITCRASQHIGQFLSWYQQKPGKAPKLLIYLASRLQSGVPSRFSGSGSGTDFTLTISSLQPEDFATYYCQQVDRIPVTFGQGTKVEIKR

SEQ ID NO: 14966 - protein, 108 aa, Homo sapiens
DIQMTQSPSSLSASVGDRVTITCRASQGIDHFLSWYQQKPGKAPKLLIYFASTLQSGVPSRFSGSGSGTDFTLTISSLQPEDFATYYCQQNASIPITFGQGTKVEIKR

SEQ ID NO: 14967 - protein, 108 aa, Homo sapiens
DIQMTQSPSSLSASVGDRVTITCRASQNIGTNLKWYQQKPEKAPKLLIYYGSLLQSGVPSRFSGSGSGTDFTLTISSLQPEDFATYYCQQDYDFPYTFGQGTKVEIKR

SEQ ID NO: 14968 - protein, 108 aa, Homo sapiens
DIQMTQSPSSLSASVGDRVSITCRASQWIGGELNWYQQKPGKAPKLLIYWVSTLQSGVPSRFSGSGSGTDFTLTISSLQPEDFATYYCQQIARYPATFGQGTKVEIKR

SEQ ID NO: 14969 - protein, 108 aa, Homo sapiens
DIQMTQSPSSLSASVGDRVTITCRASQNIGVNLIWYQQKPGKAPRLLIYFSSLLQSGVPSRFSGSGSGTDFTLTISSLQPEDFATYYCQQDYDVPQTFGQGTKVEIKR

SEQ ID NO: 14970 - protein, 108 aa, Homo sapiens
DIQMTQSPSSLSASVGDRVTITCRASQNIGSGLHWYQQKPGKAPKLLIVSWSGLQSGVPSRFSGSGSGTDFTLTISSLQPEDFATYYCGQDVLGPPTFGQGTKVEIKR

SEQ ID NO: 14971 - protein, 108 aa, Homo sapiens
DIQMTQSPSSLSASVGDRVTITCRASQWIGASLAWYQQKPGKAPKLLIYFMSELQSGVPSRFSGSGSGTDFTLTISSLQPEDFATYYCQQDYGYPTTFGQGTKVEIKR

SEQ ID NO: 14972 - protein, 108 aa, Homo sapiens
DIQMTQSPSSLSASVGDRVTITCRASQWIGVNLLWYQQKPGKAPKLLIYYGSILQSGVPSRFSGSGSGTDFTLTISSLQPEDFATYYCQQDYHGPYTFGQGTKVEIKR

SEQ ID NO: 14973 - protein, 108 aa, Homo sapiens
DIQMTQSPSSLSASVGDRVTITCRTSQDIGSLLSWYQQKPGKAPKLLIYMVSMLQSGVPSRFSGSGSGTDFTLTISSLQPEDFATYYCQHNSWYPITFGQGTKVEIKR

SEQ ID NO: 14974 - protein, 108 aa, Homo sapiens
DIQMTQSPSSLSASVGDRVTITCRASQFIYTMLNWYQQKPGKAPKLLIYRTSWLQSGVPSRFSGSGSGTDFTLTISSLQPEDFATYYCQQDYASPFTFGQGTKVEIKR

SEQ ID NO: 14975 - protein, 108 aa, Homo sapiens
DIQMTQSPSSLSASVGDRVTITCRASQWIGILLDWYQQKPGEAPKLLIYYASFLQSGVPSRFSGSGFGTDFTLTISSLQPEDFATYYCQQANPAPLTFGQGTKVEIKR

SEQ ID NO: 14976 - protein, 108 aa, Homo sapiens
DIQMTQSPSSLSASVGDRVTITCRASQWIGILIDWYQQKPGEAPKLLIYYASFLQSGVPSRFSGSGSGTDFTLTISSLQPEDSATYYCQQANPAPLTFGQGTKVEIKR

SEQ ID NO: 14977 - protein, 108 aa, Homo sapiens
DIQLTQSPSSLSASVGDRVTITCRASQWIGILLDWYQQKPGEAPKLLIYYASFLQSGVPSRFSGSGSGTDFTLTINSLQPEDFATYYCQQANPAPLTFGQGTKVEIKR

SEQ ID NO: 14978 - protein, 108 aa, Homo sapiens
DIQMTQSPSFLSASVGDRVTITCRASQWIGILLDWYQQKPGEAPKLLIYYASFLQSGVPSRFSGSGSGTDFTLTISSLQPEDFATYYCQQANPAPLTLGQGTKVEIKR

SEQ ID NO: 14979 - protein, 108 aa, Homo sapiens
DIQMTQSPSSLSASVGDRVTITCRASQWIGILVDWYQQKPGEAPKLLIYYASFLQSGVPSRFSGSGSGTDFTLTISSLQPEDFATYYCQQANPAPLRFGQGTKVEIKR

SEQ ID NO: 14980 - protein, 108 aa, Homo sapiens
DIQMTQSPSSLSASVGDRVTITCRASQWIGILLDWYQQKPGEAPKLLIYYASFLQNGVPSRFSGSGSGTDFTLTISSLQPEDFATYYCQQANPAPLTFGQGTKVEIKR

SEQ ID NO: 14981 - protein, 108 aa, Homo sapiens
DIQMIQSPSSLSASVGDRVTITCRASQWIGILLDWYQQKPGEAPKLLIYYASFLQSGVPSRFSGSGSGTDFTLTISNLQPEDFATYYCQQANPAPLTFGQGTKVEIKR

SEQ ID NO: 14982 - protein, 108 aa, Homo sapiens
DIQMTQSPSSLSASVGDRVTITCRASQWIGILVDWYQQKPGEAPKLLIYYASFLQSGVPSRFSGSGFGTDFTLTISSLHPEDFATYYCQQANPAPLTFGQGTKVEIKR

SEQ ID NO: 14983 - protein, 108 aa, Homo sapiens
DIQMTQSPSSLSASVGDRVTITCRASQWIGILLDWYQQKPGEAPKLLIYYASFLQSGVPSRFSGSGSGTDFTLTISNLQPEDFATYYCQQADPAPLTFGQGTKVEIKR

SEQ ID NO: 14984 - protein, 108 aa, Homo sapiens
DIQMTQSPSSLSASVGDSVTITCRASQWIGILLDWYQQKPGEAPKLLIYYASFLQSGVPSRFSGSGSGTDFTLTISSLQPEDFATYYCQQANPAPLTFGQGTKVEIKR

SEQ ID NO: 14985 - protein, 108 aa, Homo sapiens
DIQMTQYPSSLSASVGDRVTITCRASQWIGILLDWYQQKPGEAPKLLIYYASFLQSGVPSRFSGSGSGTDFTLTISSLQPEDFGTYYCQQANPAPLTFGQGTKVEIKR

SEQ ID NO: 14986 - protein, 108 aa, Homo sapiens
DIQMTQSPSSLYASVGDRVTITCRASQWIGILLDWYQQKPGEAPKLLIYYASFLQSGVPSRFSGSGSGTDFTLTISSLQPEDFATYYCQQANPAPLTFGQGTKVEIKR

SEQ ID NO: 14987 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQPANPAPLTFGQGTKVEIKR

SEQ ID NO: 14988 - protein, 108 aa, Homo sapiens
DIQMTQSPSSLSASVGDRVTITCRSSRWIGILLDWYQQKPGEAPKLLIYYASFLQSGVPSRFSGSGSGTDFTLTISSLQPEDVATYYCQQANPAPLTFGQGTKVEIKR

SEQ ID NO: 14989 - protein, 108 aa, Homo sapiens
DIQMTQSPSSLSASVGDRVTITCRASQWIGILVDWYQQKPGEAPKLLIYYASFLQSGVPSRFSGSGSGTDFTLTISSLQPEDFATYYCQQANPAPLTFGQGTKVEIKR

SEQ ID NO: 14990 - protein, 108 aa, Homo sapiens
DIQLTQSPSSLSASVGDRVTITCRASQWIGILLDWYQQKPGEAPKLLIYYASFLQSGVPSRFSGSGSGTDFTLTISSLQPEDFATYYCQQANPAPLTFGQGTKVEIKR

SEQ ID NO: 14991 - protein, 108 aa, Homo sapiens
DIQMTQSPTSLSASVGDRVTITCRASQWIGNLLDWYQQKPGEAPKLLIYYASFLQSGVPSRFSGGGFGTDFTLTISSLQPEDFATYYCQQANPAPLTFGQGTKVEIKR

SEQ ID NO: 14992 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPAPPTFGQGTKVEIKR

SEQ ID NO: 14993 - protein, 108 aa, Homo sapiens
DIQMTQSPSSLSASVGDRVTITCRASQWIGILLDWYQQKPGEDPKLLIYYASFLQSGVPSRFSGSGSGTDFTLTISSLQPEDFATYYCQQANPAPLTFGQGTKVEIKR

SEQ ID NO: 14994 - protein, 108 aa, Homo sapiens
DIQMTQSPTSLSASVGDRVTITCRASQWIGILLDWYQQKPGEAPKLLIYYASFLQSGVPSRFSGSGSGTDFTLTISSLQPEDFATYYCQQANPAPLTFGQGTKVEIKR

SEQ ID NO: 14995 - protein, 108 aa, Homo sapiens
DIQMTQSPSSLSASVGDRVTITCRASQWIGILVDWYQQKPGEAPKLLIYYGSFLQSGVPSRFSGSGSGTDFTLTISSLQPEDFATYYCQQANPAPLTFGQGTKVEIKR

SEQ ID NO: 14996 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPAPLTFGQGTKVEIRR

SEQ ID NO: 14997 - protein, 108 aa, Homo sapiens
DIQMTQSPSSLSASVGDRVTITCRASQWIGILLDWYQQKPGEAPKLLIYYASFLQSGVPSRFSGSGYGTDFTLTISSLQPEDFATYYCQQANPAPLTFGQGTKVEIKR

SEQ ID NO: 14998 - protein, 108 aa, Homo sapiens
DIQMTQSPSSLSASVGDRVTITCRASQWIGILLDWYQQKPGEAPKLLIYYASFLQSGVPSRFSGSGSGTDFTLTISSLQPEDFATYYCQQANPAPLTFGQGTKVEMKR

SEQ ID NO: 14999 - protein, 108 aa, Homo sapiens
DIQMTQSPSSLSASVGDRVTITCRASQWIGILLDWYQQKPGEDPKLLIYYASFLQSGVPSRFSGSGSGTDFTLTISSLQPEDFATYYCQQANPAPLMFGQGTKVEIKR

SEQ ID NO: 15000 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPAPLTFGQGTKVEIKR

SEQ ID NO: 15001 - protein, 108 aa, Homo sapiens
DIQMTQSPSSLSASVGDRVTITCRASQWIGILVDWYQQKPGKAPKLLIYYASFLQSGVPSRFSGSGSGTDFTLTISSLQPEDFATYYCQQANPAPLTFGQGTKVEIKR

SEQ ID NO: 15002 - protein, 108 aa, Homo sapiens
DIQMTQSPSSLSASVGDRVTITCRASQWIGILLDWYQQKPGKAPKLLIYYASFLQSGVPSRFSGSGSGTDFTLTISSLQPEDFATYYCQQANPAPLRFGQGTKVEIKR

SEQ ID NO: 15003 - protein, 108 aa, Homo sapiens
DIQMTQSPSSLSASVGDRVTITCRASQWIGILIDWYQQKPGKAPKLLIYYASFLQSGVPSRFSGSGSGTDFTLTISSLQPEDFATYYCQQANPAPLTFGQGTKVEIKR

SEQ ID NO: 15004 - protein, 108 aa, Homo sapiens
DIQMTQSPSSLSASVGDRVTITCRASQWIGNLVDWYQQKPGKAPKLLIYYASFLQSGVPSRFSGSGSGTDFTLTISSLQPEDFATYYCQQANPAPLTFGQGTKVEIKR

SEQ ID NO: 15005 - protein, 108 aa, Homo sapiens
DIQMTQSPSSLSASVGDRVTITCRASQWIGNLVDWYQQKPGKAPKLLIYYASFLQSGVPSRFSGSGSGTDFTLTISSLQPEDFATYYCQQANPAPPTFGQGTKVEIKR

SEQ ID NO: 15006 - protein, 108 aa, Homo sapiens
DIQMTQSPSSLSASVGDRVTITCRASQWIGINLDWYQQKPGKAPKLLIYYASFLQSGVPSRFSGSGSGTDFTLTISSLQPEDFATYYCQQANPAPLTFGQGTKVEIKR

SEQ ID NO: 15007 - protein, 108 aa, Homo sapiens
DIQMTQSPSSLSASVGDRVTITCRASQNIGNLLDWYQQKPGKAPKLLIYYASFLQSGVPSRFSGSGFGTDFTLTISSLQPEDFATYYCQQANPAPLTFGQGTKVEIKR

SEQ ID NO: 15008 - protein, 108 aa, Homo sapiens
DIQMTQSPSSLSASVGDRVTITCRASQWIGINLDWYQQKPGKAPRLLIYYASFLQSGVPSRFSGSGSGTDFTLTISSLQPEDFATYYCQQANPAPLTFGQGTKVEIKR

SEQ ID NO: 15009 - protein, 119 aa, Homo sapiens
EVQLLESGGGLVQPGGSLRLSCAASGFTFAEQPMTWARQAPGKGLEWVSSISSFGDLTYYADSVKGRFTISRDNSKNTLYLQMNSLRAEDTAVYYCAKGVYRISRFDYWGQGTLVTVSS

SEQ ID NO: 15010 - protein, 127 aa, Unknown; identical to SEQ ID NO: 10853
  Description of Unknown: Camelid sequence

SEQ ID NO: 15011 - protein, 127 aa, Unknown; identical to SEQ ID NO: 10854
  Description of Unknown: Camelid sequence

SEQ ID NO: 15012 - protein, 122 aa, Unknown; identical to SEQ ID NO: 10855
  Description of Unknown: Camelid sequence

SEQ ID NO: 15013 - protein, 129 aa, Unknown; identical to SEQ ID NO: 10856
  Description of Unknown: Camelid sequence

SEQ ID NO: 15014 - protein, 125 aa, Unknown; identical to SEQ ID NO: 10857
  Description of Unknown: Camelid sequence

SEQ ID NO: 15015 - protein, 129 aa, Unknown; identical to SEQ ID NO: 10858
  Description of Unknown: Camelid sequence

SEQ ID NO: 15016 - protein, 122 aa, Unknown; identical to SEQ ID NO: 10859
  Description of Unknown: Camelid sequence

SEQ ID NO: 15017 - protein, 121 aa, Unknown; identical to SEQ ID NO: 10860
  Description of Unknown: Camelid sequence

SEQ ID NO: 15018 - protein, 122 aa, Unknown; identical to SEQ ID NO: 10861
  Description of Unknown: Camelid sequence

SEQ ID NO: 15019 - protein, 123 aa, Unknown; identical to SEQ ID NO: 10862
  Description of Unknown: Camelid sequence

SEQ ID NO: 15020 - protein, 123 aa, Unknown; identical to SEQ ID NO: 10863
  Description of Unknown: Camelid sequence

SEQ ID NO: 15021 - protein, 133 aa, Unknown; identical to SEQ ID NO: 10864
  Description of Unknown: Camelid sequence

SEQ ID NO: 15022 - protein, 120 aa, Unknown
  Description of Unknown: Camelid sequence
  MOD_RES (3)..(3): Any amino acid
  MOD_RES (13)..(13): Any amino acid
EVXLVESGGGLVXPGGSLRLSCVASGFTFADYAMSWVRQAPGKGLQWVSSISYNGDTTYYAESMKDRFTISRDNAKNTLYLQMNSLKSEDTAVYYCASSGSYYPGHFESWGQGTQVTVSS

SEQ ID NO: 15023 - protein, 121 aa, Unknown; identical to SEQ ID NO: 10866
  Description of Unknown: Camelid sequence

SEQ ID NO: 15024 - protein, 123 aa, Unknown; identical to SEQ ID NO: 10867
  Description of Unknown: Camelid sequence

SEQ ID NO: 15025 - protein, 122 aa, Unknown; identical to SEQ ID NO: 10868
  Description of Unknown: Camelid sequence

SEQ ID NO: 15026 - protein, 121 aa, Unknown; identical to SEQ ID NO: 10869
  Description of Unknown: Camelid sequence

SEQ ID NO: 15027 - protein, 127 aa, Unknown; identical to SEQ ID NO: 10870
  Description of Unknown: Camelid sequence

SEQ ID NO: 15028 - protein, 126 aa, Unknown; identical to SEQ ID NO: 10871
  Description of Unknown: Camelid sequence

SEQ ID NO: 15029 - protein, 126 aa, Unknown; identical to SEQ ID NO: 10872
  Description of Unknown: Camelid sequence

SEQ ID NO: 15030 - protein, 126 aa, Unknown; identical to SEQ ID NO: 10873
  Description of Unknown: Camelid sequence

SEQ ID NO: 15031 - protein, 123 aa, Unknown; identical to SEQ ID NO: 10874
  Description of Unknown: Camelid sequence

SEQ ID NO: 15032 - protein, 108 aa, Homo sapiens
DIQMTQSPSSLSASVGDRVTITCRASQSIIKHLKWYQQKPGKAPKLLIYGASRLQSGVPSRFSGSGSGTDFTLTISSLQPEDFATYYCQQGARWPQTFGQGTKVEIKR

SEQ ID NO: 15033 - protein, 108 aa, Homo sapiens
DIQMTQSPSSLSASVGDRVTITCRASQSIFRHLKWYQQKPGKAPKLLIYAASRLQSGVPSRFSGSGSGTDFTLTISSLQPEDFATYYCQQVALYPKTFGQGTKVEIKR

SEQ ID NO: 15034 - protein, 108 aa, Homo sapiens
DIQMTQSPSSLSASVGDRVTITCRASQSIYYHLKWYQQKPGKAPKLLIYKASTLQSGVPSRFSGSGSGTDFTLTISSLQPEDFATYYCQQVRKVPRTFGQGTKVEIKR

SEQ ID NO: 15035 - protein, 108 aa, Homo sapiens
DIQTTQSPSSLSASVGDRVTITCRASQYIGRYLRWYQQKPGKAPKLLIYDSSVLQSGVPSRFSGSGSGTDFTLTISSLQPEDFATYYCQQRYRMPYTFGQGTRVEIKR

SEQ ID NO: 15036 - protein, 108 aa, Homo sapiens
DIQMTQSPSSLSASVGDRVTITCRASQYIGRYLRWYQQKPGKAPKLLIYDSSVLQSGVPSRFSGSGSGTDFTLTISSLQPEDFATYYCQQRYMQPFTFGQGTKVEIKR

SEQ ID NO: 15037 - protein, 108 aa, Homo sapiens
DIQMTQSPSSLSASVGDRVTITCRASQWIGRYLRWYQQKPGKAPKLLIYNGSQLQSGVPSRFSGSGSGTDFTLTISSLQPEDFATYYCQQRYLQPYTFGQGTKVEIKR

SEQ ID NO: 15038 - protein, 108 aa, Homo sapiens
DIQMTQSPSSLSASVGDRVTITCRASQYISRQLRWYQQKPGKAPRLLIYGASVLQSGIPSRFSGSGSGTDFTLTISSLQPEDFATYYCQQRYITPYTFGQGTKVEVKR

SEQ ID NO: 15039 - protein, 108 aa, Homo sapiens
DIQMTQSPSSLSASVGDRVTITCRASQYIGRYLRWYQQKPGKAPKLLIYDSSVLQSGVPSRFSGSGSGTDFTLTISSLQPEDFATYYCQQRYSSPYTFGQGTKVEIKR

SEQ ID NO: 15040 - protein, 108 aa, Homo sapiens
DIQMTQSPSSLSASVGDRVTITCRASQWIHRQLKWYQQKPGKAPKLLIYYASILQSGVPSRFSGSGSGTDFTLTISSLQPEDFATYYCQQTFSKPSTFGQGTKVEIKR

SEQ ID NO: 15041 - protein, 108 aa, Homo sapiens
DIQMTQSPSSLSASVGDRVTITCRASQKIATYLNWYQQKPGKAPKLLIYRSSSLQSAVPSRFSGSGSGTVFTLTISSLQPEDFATYYCQQTYAVPPTFGQGTKVEIKR

SEQ ID NO: 15042 - protein, 108 aa, Homo sapiens
DIQMTQSPSSLSASVGDRVTITCRASQWIDTGLAWYQQKPGKAPRLLIYNVSRLQSGVPSRFSGSGSGTDFTLTISSLQPEDFATYYCQQYWGSPTTFGQGTKVEIKR

SEQ ID NO: 15043 - protein, 108 aa, Homo sapiens
DIQMTQSPSSLSASVGDRVTITCRASQEIYSWLAWYQQRPGKAPKLLIYNASHLQSGVPSRFSGSGSGTDFTLTISSLQPEDFATYYCQQVIGDPVTFGQGTKVEIKR

SEQ ID NO: 15044 - protein, 108 aa, Homo sapiens
DIQMTQSPSSLSASVGDRVTITCRASQSISSYLNWYQQKPGKAPTLLIYRLSVLQSGVPSRFSGSGSGTDFTLTISSLQPEDFATYYCQQTYNVPPTFGQGTKVEIKR

SEQ ID NO: 15045 - protein, 108 aa, Homo sapiens
DIQMTQSPSSLSASVGDRVTITCRASQSISSYLNWYQQKPGKAPKLLIYRNSFLQSGVPSRFSGSGSGTDFTLTISSLQPEDFATYYCQQTYTVPPTFGQGTKVEIKQ

SEQ ID NO: 15046 - protein, 108 aa, Homo sapiens
DIQMTQSPSSLSASVGDRVTITCRASQSISSYLNWYQQKPGKAPKLLIYRNSQLQSGVPSRFSGSGSGTDFTLTISSLQPEDFATYYCQQTFAVPPTFGQGTKVEIKR

SEQ ID NO: 15047 - protein, 123 aa, Homo sapiens
EVQLLESGGGLVQPGGSLRLSCAASGFTFSKYWMSWVRQAPGKGLEWVSSIDFMGPHTYYADSVKGRFTISRDNSKNTLYLQMNSLRAEDTAVYYCAKGRTSMLPMKGKFDYWGQGTLVTVSS

SEQ ID NO: 15048 - protein, 118 aa, Homo sapiens
EVQLLESGGGLVQPGGSLRLSCAASGFTFYDYNMSWVRQAPGKGLEWVSTITHTGGVTYYADSVKGRFTISRDNSKNTLYLQMNSLRAEDTAVYYCAKQNPSYQFDYWGQGTLVTVSS

SEQ ID NO: 15049 - protein, 118 aa, Homo sapiens
EVQLLESGGGLVQPGGSLRLSCAASGFTFHRYSMSWVRQAPGKGLEWVSTILPGGDVTYYADSVKGRFTISRDNSKNTLYLQMNSLRAEDTAVYYCAKQTPDYMFDYWGQGTLVTVSS

SEQ ID NO: 15050 - protein, 117 aa, Homo sapiens
EVQLLESGGGLVQPGGSLRLSCAASGFTFWKYNMAWVRQAPGKGLEWVSTILGEGNNTYYADSVKGRFTISRDNSKNTLYLQMNSLRAEDTAVYYCAKTMDYKFDYWGQGTLVTVSS

SEQ ID NO: 15051 - protein, 118 aa, Homo sapiens
EVQLLESGGGLVQPGGSLRLSCTASGFTFDEYNMSWVRQAPGKGLEWVSTILPHGDRTYYADSVKGRFTISRDNSKNTLYLQMNSLRAEDTAVYYCAKQDPLYRFDYWGQGTLVTVSS

SEQ ID NO: 15052 - protein, 120 aa, Homo sapiens
EVQLLESGGGLVQPGGSLRLSCAASGFTFDLYDMSWVRQAPGKGLEWVSSIVNSGVRTYYADSVKGRFTISRDNSKNTLYLQMNSLRAEDTAVYYCAKLNQSYHWDFDYWGQGTLVTVSS

SEQ ID NO: 15053 - protein, 118 aa, Homo sapiens
EVQLLESGGGLVQPGGSLRLSCAASGFTFSDYRMSWVRQAPGKGLEWVSTIISNGKFTYYADSVKGRFTISRDNSKNTLYLQMNSLRAEDTAVYYCAKQDWMYMFDYWGQGTLVTVSS

SEQ ID NO: 15054 - protein, 108 aa, Homo sapiens
DIQMTQSPSSLSASVGDRVTITCRASQSISSYLNWYQQKPGKAPKLLIYRNSPLQSGVPSRFSGSGSGTDFTLTISSLQPEDFATYYCQQTYRVPPTFGQGTKVEIKR

SEQ ID NO: 15055 - protein, 108 aa, Homo sapiens
DIQMTQSPSSLSASVGDRVTITCRASQHIHRELRWYQQKPGKAPKLLIYQASRLQSGVPSRFSGSGSGTDFTLTISSLQPEDFATYYCQQKYLPPYTFGQGTKVEIKR

SEQ ID NO: 15056 - protein, 108 aa, Homo sapiens
DIQMTQSPSSLSASVGDRVTITCRASQHIHRELRWYQQKPGKAPKLLIYQASRLQSGVPSRFSGSGSGTDFTLTISSLQPEDFATYYCQQRYRVPYTFGQGTKVEIKR

SEQ ID NO: 15057 - protein, 108 aa, Homo sapiens
DIQMTQSPSSLSASVGDRVTITCRASQSIGRRLKWYQQKPGAAPRLLIYRTSWLQSGVPSRFSGSGSGTDFTLTISSLQPEDFATYYCQQTSQWPHTFGQGTKVEIKR

SEQ ID NO: 15058 - protein, 108 aa, Homo sapiens
DIQMTQSPSSLSASVGDRVTITCRASQKIYKNLRWYQQKPGKAPKLLIYNSSILQSGVPSRFSGSGSGTDFTLTISSLQPEDFATYYCQQRYLSPYTFGQGTKVEIKR

SEQ ID NO: 15059 - protein, 108 aa, Homo sapiens
DIQMTQSPSSLSASVGDRVTITCRASQKIYNNLRWYQQKPGKAPKLLIYNTSILQSGVPSRFSGSGSGTDFTLTISSLQPEDFATYYCQQRWRAPYTFGQGTKVEIKR

SEQ ID NO: 15060 - protein, 108 aa, Homo sapiens
DIQMTQSPSSLSASVGDRVTITCRASQWIYKSLGWYQQKPGKAPKLLIYQSSLLQSGVPSRFSGSGSGTDFTLTISSLQPEDFATYYCQQYHQMPRTFGQGTKVEIKR

SEQ ID NO: 15061 - protein, 108 aa, Homo sapiens
DIQMTQSPSSLSASVGDRVTITCRASQWIYRHLRWYQQKPGKAPKLLIYDASRLQSGVPTRFSGSGSGTDFTLTISSLQPEDFATYYCQQTHNPPKTFGQGTKVEIKR

SEQ ID NO: 15062 - protein, 116 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKGGKDFDYWGQGTLVTVSS

SEQ ID NO: 15063 - protein, 117 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKGNLEPFDYWGQGTLVTVSS

SEQ ID NO: 15064 - protein, 117 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKKLSNGFDYWGQGTLVTVSS

SEQ ID NO: 15065 - protein, 118 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKVVKDNTFDYWGQGTLVTVSS

SEQ ID NO: 15066 - protein, 118 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKNTGGKQFDYWGQGTLVTVSS

SEQ ID NO: 15067 - protein, 118 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKKTGPSSFDYWGQGTLVTVSS

SEQ ID NO: 15068 - protein, 120 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKRTENRGVSFDYWGQGTLVTVSS

SEQ ID NO: 15069 - protein, 122 aa, Homo sapiens
EVQLLESGGGLVQPGGSLRLSCAASGFTFWPYTMSWVRQAPGKGLEWVSTISPFGSTTYYADSVKGRFTISRDNSKNTLYLQMNSLRAEDTAVYYCAKSDVLKTGLDGFDYWGQGTLVTVSS

SEQ ID NO: 15070 - protein, 120 aa, Homo sapiens
EVQLLESGGGLVQPGGSLRLSCAASGFTFMAYQMAWVRQAPGKGLEWVSTIHQTGFSTYYADSVKGRFTISRDNSKNTLYLQMNSLRAEDTAVYYCAKVRSMRPYKFDYWGQGTLVTVSS

SEQ ID NO: 15071 - protein, 120 aa, Homo sapiens
EVQLLESGGGLVQPGGSLRLSCAASGFTFKDYDMTWVRQAPGKGLEWVSMISSSGLWTYYADSVKGRFTISRDNSKNTLYLQMNSLRAEDTAVYYCAKGFRLFPRTFDYWGQGTLVTVSS

SEQ ID NO: 15072 - protein, 121 aa, Homo sapiens
EVQLLESGGGLVQPGGSLRLSCAASGFTFHDYVMGWARQAPGKGLEWVSLIKPNGSPTYYADSVKGRFTISRDNSKNTLYLQMNSLRAEDTAVYYCAKGRGRFNVLQFDYWGQGTLVTVSS

SEQ ID NO: 15073 - protein, 118 aa, Homo sapiens
EVQLLESGGGLVQPGGSLRLSCTASGFTFRHYRMGWVRQAPGKGLEWVSWIRPDGTFTYYADSVKGRFTISRDNSKNTLYLQMNSLRAEDTAVYYCAKSYMGDRFDYWGQGTLVTVSS

SEQ ID NO: 15074 - protein, 116 aa, Homo sapiens
EVQLLESGGGLVQPGGSLRLSCAASGFTFMWDKMGWVRQAPGKGLEWVSFIGREGYGTYYADSVKGRFTISRDNSKNTLYLQMNSLRAEDTAVYYCAKSVASFDYWGQGTLVTVSS

SEQ ID NO: 15075 - protein, 117 aa, Homo sapiens
EVQLLESGGGLVQPGGSLRLSCAASGFTFWAYPMSWVRQAPGKGLEWVSSISSWGTGTYYADSVKGRFTISRDNSKNTLYLQMNSLRAEDTAVYYCAKGGQGSFDYWGQGTLVTVSS

SEQ ID NO: 15076 - protein, 108 aa, Homo sapiens
DIQMTQSPSSLSASVGDRVTITCRASQWIGPELSWYQQKPGKAPKLLIYHGSILQSGVPSRFSGSGSGTDFTLTISSLQPEDFATYYCQQRMYRPATFGQGTKVEIKR

SEQ ID NO: 15077 - protein, 108 aa, Homo sapiens
DIQMTQSPSSLSASVGDRVTITCRASQWIGRELKWYQQKPGKAPRLLIYHGSVLQSGVPSRFSGSGSGTDFTLTISSLQPEDFATYYCQQDFFVPDTFGQGTKVEIKR

SEQ ID NO: 15078 - protein, 108 aa, Homo sapiens
DIQMTQSPSSLSASVGDRVTITCRASQDIANDLMWYQQKPGKAPKLLIYRNSRLQGGVPSRFSGSGSGTDFTLTISSLQPEDFATYYCQQLVHRPYTIGQGTKVEIKR

SEQ ID NO: 15079 - protein, 108 aa, Homo sapiens
DIQMTQSPSSLSASVGDRVTITCRASQFIGPHLTWYQQKPGKAPKLLIYHSSLLQSGVPSRFSGSGSGTDFTLTISSLQPEDFATYYCQQYMYYPSTFGQGTKVKIKR

SEQ ID NO: 15080 - protein, 108 aa, Homo sapiens
DIQMTQSPSSLSASVGDRVTITCRASQWIGPELSWYQQKPGKAPKLLIYHTSILQSGVPSRFSGSGSGTDFTLTISSLQPEDFATYYCQQYMFQPRTFGQGTKVEIRR

SEQ ID NO: 15081 - protein, 108 aa, Homo sapiens
DIQMIQSPSSLSASVGDRVTITCRASQFIGNELSWYQQKPGKAPKLLIYHASSLQSGVPSRFSGSGSGTDFTLTISSLQPEDFATYYCQQVLGYPYTFGQGTKVEIKR

SEQ ID NO: 15082 - protein, 108 aa, Homo sapiens
DIQMTQSPSSLSASVGDRVTITCRASQWIGPELSWYQQKPGKAPKLLIYHGSILQSGVPSRFSGSGSGTDFTLTISSLQPEDFATYYCQQVLYSPLTFGQGTKVEIKR

SEQ ID NO: 15083 - protein, 108 aa, Homo sapiens
DIQMTQSPSSLSASVGDRVTITCRASQWIGNELKWYQQKPGKAPKLLIYMSSLLQSGVPSRFSGSGSGTDFTLTISSLQPEDLATYYCQQTLLLPFTFGQGTKVEIKR

SEQ ID NO: 15084 - protein, 108 aa, Homo sapiens
DIQMTQSPSSLSASVGDRVTITCRASQWIGPELSWYQQKPGKAPKLLIYHGSILQSGVPSRFSGSGSGTDFTLTISSLQPEDFATYYCQQRLYYPGTFGQGTKVEIKR

SEQ ID NO: 15085 - protein, 108 aa, Homo sapiens
DIQMTQSPSSLSASVGDRVTITCRASQSIGRELSWYQQKPGKAPMLLIYHSSNLQSGVPSRFSGSGSGTDFTLTISSLQPEDFATYYCQQGMYWPYTFGQGTKVEIKR

SEQ ID NO: 15086 - protein, 108 aa, Homo sapiens
DIQMTQSPSSLSASVGDRVTITCRASQWIKPALHWYQQKPGKAPKLLIYHGSILQSGVPSRFSGSGSGTDFTLTISSLQPEDFATYYCQQTLFMPYTFGQGTKVEIKR

SEQ ID NO: 15087 - protein, 108 aa, Homo sapiens
DIQMTQSPSSLSASVGDRVTITCRASQSISTALLWYQQKPGKAPKLLIYNGSMLPNGVPSRFSGSGSGTDFTLTISSLQPEDFATYYCQQTWDTPMTFGQGTKVEIKR

SEQ ID NO: 15088 - protein, 108 aa, Homo sapiens
DIQMTQSPSSLSASVGDRVTITCRASQWIGHDLSWYQQKPGKAPKLLIYHSSSLQSGVPSRFSGSGSGTDFTLTISSLQPEDVATYYCQQLMGYPFTFGQGTKVEIKR

SEQ ID NO: 15089 - protein, 108 aa, Homo sapiens
DIQMTQSPSSLSASVGDRVTITCRASQDIGGLLVWYQQKPGKAPKLLIYRSSYLQSGVPSRFSGSGSGTDFTLTISSLQPEDFATYYCQQTWGIPHTFGQGTKVEIKR

SEQ ID NO: 15090 - protein, 108 aa, Homo sapiens
DIQMTQSPSSLSASVGDRVTITCRASQKIFNGLSWYQQKPGKAPKLLIYHSSTLQSGVPSRFSGSGSGTDFTLTISSLQPEDFATYYCQQVLLYPYTFGQGTKVEIKR

SEQ ID NO: 15091 - protein, 108 aa, Homo sapiens
DIQMTQSPSSLSASVGDRVTITCRASQSIGTNLSWYQQKPGKAPRLLIYRTSMLQSGVPSRFSGSGSGTDFTLTISSLQPEDFATYYCQQQFFWPHTFGQGTKVEIKR

SEQ ID NO: 15092 - protein, 118 aa, Homo sapiens
EVQLLESGGGLVQPGGSLRLSCAASGFTFRLYDMVWVRQAPGKGLEWVSYISSGGSGTYYADSVKGRFTISRDNSKNTLYLQMNSLRAEDTAVYYCAKAGGRASFDYWGQGTLVTVSS

SEQ ID NO: 15093 - protein, 116 aa, Homo sapiens
EVQLLESGGGLVQPGGSLRLSCAASGFTFHLYDMMWVRQAPGKGLEWVSFIGGDGLNTYYADSVKGRFTISRDNSKNTLYLQMNSLRAEDTAVYYCAKAGTQFDYWGQGTLVTVSS

SEQ ID NO: 15094 - protein, 119 aa, Homo sapiens
EVQLLESGGGLVQPGGSLRLSCAASGFTFNKYPMMWVRQAPGKGLEWVSEISPSGQDTYYADSVKGRFTISRDNSKNTLYLQMNSLRAEDTAVYYCAKNPQILSNFDYWGQGTLVTVSS

SEQ ID NO: 15095 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGDRTAGSRGNSFDYWGQGTLVTVSS

SEQ ID NO: 15096 - protein, 121 aa, Homo sapiens
EVQLLESGGGLVQPGGSLRLSCAASGFTFKAYEMGWVRQAPGKGLEWVSGISPNGGWTYYADSVKGRFTISRDNSKNTLYLQMNSLRAEDTAVYYCAKESISPTPLGFDYWGQGTLVTVSS

SEQ ID NO: 15097 - protein, 116 aa, Homo sapiens
EVQLLESGGGLVQPGGSLRLSCAASGFTFTGYEMGWVRQAPGKGLEWVSYISRGGRWTYYADSVKGRFTISRDNSKNTLYLQMNSLRAEDTAVYYCAKSDTMFDYWGQGTLVTVSS

SEQ ID NO: 15098 - protein, 116 aa, Homo sapiens
EVQLLESGGGLVQPGGSLRLSCAASGFTFSAYEMGWVRQAPGKGLEWVSFISGGGRWTYYADSVKGRFTISRDNSKNTLYLQMNSLRAEDTAVYYCAKYSEDFDYWGQGTLVTVSS

SEQ ID NO: 15099 - protein, 116 aa, Homo sapiens
EVQLLESGGGLVQPGGSLRLSCAASGFTFGAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15100 - protein, 123 aa, Homo sapiens
EVQLLESGGGLVQPGGSLRLSCAASGFTFQFYKMGWVRQAPGKGLEWVSSISSVGDATYYADSVKGRFTISRDNSKNTLYLQMNSLRAEDTAVYYCAKMGGGPPTYVVYFDYWGQGTLVTVSS

SEQ ID NO: 15101 - protein, 123 aa, Homo sapiens
EVQLLESGGGLVQPGGSLRLSCAASGFTFGEYGMYWVRQAPGKGLEWVSSISERGRLTYYADSVKGRFTISRDNSKNTLYLQMNNLRAEDTAVYYCAKSALSSEGFSRSFDYWGQGTLVTVSS

SEQ ID NO: 15102 - protein, 123 aa, Homo sapiens
EVQLLESGGGLVQPGGSLRLSCAASGFTFSDYAMYWVRQAPGKGLEWVSSITARGFITYYADSVKGRFTISRDNSKNTLYLQMNSLRAEDTAVYYCAKSGFPHKSGSNYFDYWGQGTLVTVSS

SEQ ID NO: 15103 - protein, 116 aa, Homo sapiens
EVQLLESGGGLVQPGGSLRLSCAASGFTFRLYDMMWVRQAPGKGLEWVSFIGGDGLNTYYADSVKGRFTISRDNSKNTLYLQMNSLRAEDTAVYYCAKDPRKFDYWGQGTLVTVSS

SEQ ID NO: 15104 - protein, 116 aa, Homo sapiens
EVQLLESGGGLVQPGGSLRLSCAASGFTFSFFDMMWVRQAPGKGLEWVSFIGGDGLNTYYADSVKGRFTISRDNSKNTLYLQMNSLRAEDTAVYYCAKAGTQFDYWGQGTLVTVSS

SEQ ID NO: 15105 - protein, 116 aa, Homo sapiens
EVQLLESGGGLVQPGGSLRLSCAASGFTFMLFDMMWVRQAPGKGLEWVSFIGGDGLNTYYADSVKGRFTISRDNSKNTLYLQMNSLRAEDTAVYYCAKAGTQFDYWGQGTLVTVSS

SEQ ID NO: 15106 - protein, 116 aa, Homo sapiens
EVQLLESGGGLVQPGGSLRLSCAASGFTFPLYDMMWVRQAPGKGLEWVSFIGGDGLNTYYADSVKGRFTISRDNSKNTLYLQMNSLRAEDTAVYYCAKAGTQFDYWGQGTLVTVSS

SEQ ID NO: 15107 - protein, 116 aa, Homo sapiens
EVQLLESGGGLVQPGGSLRLSCAASGFTFQYFDMMWVRQAPGKGLEWVSFIGGDGLNTYYADSVKGRFTISRDNSKNTLYLQMNSLRAEDTAVYYCAKAGTQFDYWGQGTLVTVSS

SEQ ID NO: 15108 - protein, 116 aa, Homo sapiens
EVQLLESGGGLVQPGGSLRLSCAASGFTFHLYDMMWVRQAPGKGLEWVSFIGGDGLNTYYADSVKGRFTISRDNSKNTLYLQMNSLRAEDTAVYYCAKSPRQFDYWGQGTLVTVSS

SEQ ID NO: 15109 - protein, 116 aa, Homo sapiens
EVQLLESGGGLVQPGGSLRLSCAASGFTFHLYDMMWVRQAPGKGLEWVSFIGGDGLNTYYADSVKGRFTISRDNSKNTLYLQMNSLRAEDTAVYYCAKNPRQFDYWGQGTLVTVSS

SEQ ID NO: 15110 - protein, 116 aa, Homo sapiens
EVQLLESGGGLVQPGGSLRLSCAASGFTFHLYDMMWVRQAPGKGLEWVSFIGGDGLNTYYADSVKGRFTISRDNSKNTLYLQMNSLRAEDTAVYYCAKKSMQFDYWGQGTLVTVSS

SEQ ID NO: 15111 - protein, 116 aa, Homo sapiens
EVQLLESGGGLVQPGGSLRLSCAASGFTFHLYDMMWVRQAPGKGLEWVSFIGGDGLNTYYADSVKGRFTISRDNSKNTLYLQMNSLRAEDTAVYYCAKSPRKFDYWGQGTLVTVSS

SEQ ID NO: 15112 - protein, 116 aa, Homo sapiens
EVQLLESGGGLVQPGGSLRLSCAASGFTFHLYDMMWVRQAPGKGLEWVSFIGGDGLNTYYADSVKGRFTISRDNSKNTLYLQMNSLRAEDTAVYYCAKDPRKFDYWGQGTLVTVSS

SEQ ID NO: 15113 - protein, 119 aa, Homo sapiens
EVQLLESGGGLVQPGGSLRLSCAASGYPMWWVRQAPGKGPEWVSLIEGQGDRTYYADSVKGRFTISRDNSKNTLYLQMNSLRAEDTAVYYCAKAGDRTAGSRGNSFDYWGQGTLVTVSS

SEQ ID NO: 15114 - protein, 124 aa, Homo sapiens
EVQLLESGGGLVQPGGSLRLSCAASGFTFQWAPMPWVRQAPGKGLEWVSLIEGQGDRTYYADSVKGRFTISRDNSKNTLYLQMNSLRAEDTAVYYCAKAGDRTAGSRGNSFDYWGQGTLVTVSS

SEQ ID NO: 15115 - protein, 124 aa, Homo sapiens
EVQLLESGGGLVQPGGSLRLSCAASGFTFQWPHMPWVRQAPGKGLEWVSLIEGQGDRTYYADSVKGRFTISRDNSKNTLYLQMNSLRAEDTAVYYCAKAGDRTAGSRGNSFDYWGQGTLVTVSS

SEQ ID NO: 15116 - protein, 124 aa, Homo sapiens
  MOD_RES (30)..(30): Any amino acid
EVQLLESGGGLVQPGGSLRLSCAASGFTFXWPHMHWVRQAPGKGLEWVSLIEGQGDRTYYADSVKGRFTISRDNSKNTLYLQMNSLRAEDTAVYYCAKAGDRTAGSRGNSFDYWGQGTLVTVSS

SEQ ID NO: 15117 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGDRWVLSRGNSFDYWGQGTLVTVSS

SEQ ID NO: 15118 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGDRRFLSRGNSFDYWGQGTLVTVSS

SEQ ID NO: 15119 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGDRHRTSRGNSFDYWGQGTLVTVSS

SEQ ID NO: 15120 - protein, 124 aa, Homo sapiens
EVQLLESGGGLVQPGGSLRLSCAASGFTFQWYPMWWVRQAPGKGLEWVSLIEVQGDRTYYADSVKGRFTISRDNSKNTLYLQMNSLRAEDTAVYYCAKAGPPFAGSRGNSFDYWGQGTLVTVSS

SEQ ID NO: 15121 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGTNNAGSRGNSFDYWGQGTLVTVSS

SEQ ID NO: 15122 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGDRTAQNSGNSFDYWGRGTLVTVSS

SEQ ID NO: 15123 - protein, 124 aa, Homo sapiens
EVQLLESGGGLVQPGGSLRLSCAASGFTFQWYPMWWVRQAPGKGLEWVSLIEGQGDRTYYADSVKGRFTISRDNSKNTLYLQMNSLRAEDTAVYYCAKAGNSNAGSRGNSFDYWGQGTLVTVSS

SEQ ID NO: 15124 - protein, 116 aa, Homo sapiens
EVQLLESGGGLVQPGGSLRLSCAASGFTFPAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15125 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15126 - protein, 114 aa, Homo sapiens
EVQLLESGGGLVQPGGSLRLSCAASGFTFTAYPMMWVRQAPGKGLEWVSEISPSGSYTYYADSVKGRFTISRDNSKNTLYLQMNSLRAEDTAVYYCAKDPRKFDYWGQGTLVTV

SEQ ID NO: 15127 - protein, 116 aa, Homo sapiens
EVQLLESGGGLVQPGGSLRLSCAASGFTFGWYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15128 - protein, 114 aa, Homo sapiens
EVQLLESGGGLVQPGGSLRLSCAASGFTFGLYPMMWVRQAPGKGLEWVSEISPSGSYTYYADSVKGRFTISRDNSKNTLYLQMNSLRAEDTAVYYCAKDPRKFDYWGQGTLVTV

SEQ ID NO: 15129 - protein, 116 aa, Homo sapiens
EVQLLESGGGLVQPGGSLRLSCAASGFTFLAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15130 - protein, 116 aa, Homo sapiens
EVQLLESGGGLVQPGGSLRLSCAASGFTFGRYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15131 - protein, 116 aa, Homo sapiens
EVQLLESGGGLVQPGGSLRLSCAASGFTFGAFPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15132 - protein, 116 aa, Homo sapiens
EVQLLESGGGLVQPGGSLRLSCAASGFTFGAYPMLWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15133 - protein, 116 aa, Homo sapiens
EVQLLESGGGLVQPGGSLRLSCAASGFTFSLFPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15134 - protein, 116 aa, Homo sapiens
EVQLLESGGGLVQPGGSLRLSCAASGFTFFLFPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15135 - protein, 116 aa, Homo sapiens
EVQLLESGGGLVQPGGSLRLSCAASGFTFSYFPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15136 - protein, 116 aa, Homo sapiens
EVQLLESGGGLVQPGGSLRLSCAASGFTFAFAPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15137 - protein, 116 aa, Homo sapiens
EVQLLESGGGLVQPGGSLRLSCAASGFTFAPYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15138 - protein, 116 aa, Homo sapiens
EVQLLESGGGLVQPGGSLRLSCAASGFTFTSHPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15139 - protein, 116 aa, Homo sapiens
EVQLLESGGGLVQPGGSLRLSCAASGFTFTSHPMMWVRQAPGKGLEWVSEISPSGSYTYYADSVKGRFTISRDNSKNALYLQMNSLRAEDTAVYYCAKDPRKFDYWGQGTLVTVSS

SEQ ID NO: 15140 - protein, 116 aa, Homo sapiens
EVQLLESGGGLVQPGGSLRLSCAASGFTFHAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15141 - protein, 116 aa, Homo sapiens
EVQLLESGGGLVQPGGSLRLSCAASGFTFRAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15142 - protein, 116 aa, Homo sapiens
EVQQLESGGGLVQPGGSLRLSCAASGFTFWAYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15143 - protein, 114 aa, Homo sapiens
EVQLLESGGGLVQPGGSLRLSCAASGFTFQAYPMMWVRQAPGKGLEWVSEISPSGSYTYYADSVKGRFTISRDNSKNTLYLQMNSLRAEDTAVYYCAKDPRKFDYWGQGTLVTV

SEQ ID NO: 15144 - protein, 116 aa, Homo sapiens
EVQLLESGGGLVQPGGSLRLSCAASGFTFGHYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15145 - protein, 116 aa, Homo sapiens
EVQLLESGGGLVQPGGSLRLSCAASGFTFGLYPMMWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15146 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKDPRAFDYWGQGTLVTVSS

SEQ ID NO: 15147 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKSPRKFDYWGQGTLVTVSS

SEQ ID NO: 15148 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKTPRKFDYWGRGTLVTVSS

SEQ ID NO: 15149 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKDPREFDYWGQGTLVTVSS

SEQ ID NO: 15150 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKDPRRFDYWGQGTLVTVSS

SEQ ID NO: 15151 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKDPRFFDYWGQGTLVTVSS

SEQ ID NO: 15152 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKTPIKFDYWGQGTLVTVSS

SEQ ID NO: 15153 - protein, 116 aa, Homo sapiens
EVQLLESGGGLVQPGGSLRLSCAASGFTFKAYPIMWVRQAPGKGLEWVSEISPSGSHTYYADSVKGRFTISRDNSKNTLYLQMNSLRAEDTAVYYCAKDFSQFDYWGQGTLVTVSS

SEQ ID NO: 15154 - protein, 116 aa, Homo sapiens
EVQLLESGGGLVQPGGSLRLSCAASGFTFKAYPILWVRQAPGKGLEWVSEISPSGSYTYYADSVKGRFTISRDNSKNTLYLQMNSLRAEDTAVYYCAKDPRKFDYWGQGTLVTVSS

SEQ ID NO: 15155 - protein, 116 aa, Homo sapiens
EVQLLESGGGLVQPGGSLRLSCAASGFTFKAYPIMWVRQAPGKGLEWVSEISPSGKMKYYADSVKGRFTISRDNSKNTLYLQMNSLRAEDTAVYYCAKTPRKFDYWGRGTLVTVSS

SEQ ID NO: 15156 - protein, 116 aa, Homo sapiens
EVQLLESGGGLVQPGGSLRLSCAASGFTFKAYPIMWVRQAPGKGLEWVSEISPTGSYTYYADSVKGRFTISRDNSKNTLYLQMNSLRAEDTAVYYCAKSPRKFDYWGQGTLVTVSS

SEQ ID NO: 15157 - protein, 116 aa, Homo sapiens
EVQLLESGGGLVQPGGSLRLSCAASGFTFKAYPIMWVRQAPGKGLEWVSEISPSGSYTYYANSVKGRFTISRDNSKNTLYLQMNSLRAEDTAVYYCAKDPRAFDYWGQGTLVTVSS

SEQ ID NO: 15158 - protein, 116 aa, Homo sapiens
EVQLLESGGGLVQPGGSLRLSCAASGFTFKAYPIMWVRQAPGKGLEWVSEISPSGSYTYYADSVKGRFTISRDNSKNTLYLQMNSLRAEDTAVYYCAKTPRKFDYWGQGTLVTVSS

SEQ ID NO: 15159 - protein, 116 aa, Homo sapiens
EVQLLESGGGLVQPGGSLRLSCAASGFTFKAYPIMWVRQAPGKGLEWVSEISPSGQMRYYADSVKGRFTISRDNSKNTLYLQMNSLRAEDTAVYYCAKDPREFDYWGQGTLVTVSS

SEQ ID NO: 15160 - protein, 116 aa, Homo sapiens
EVQLLESGGGLVQPGGSLRLSCAASGFTFKAYPIMWVRQAPGKGLEWVSEISPSGRSRYYADSVKGRFTISRDNSKNTLYLQMNSLRAEDTAVYYCAKDPREFDYWGQGTLVTVSS

SEQ ID NO: 15161 - protein, 116 aa, Homo sapiens
EVQLLESGGGLVQPGGSLRLSCAASGFTFKAYPIMWVRQAPGKGLEWVSEISPSGRYSYYADSVKGRFTISRDNSKNTLYLQMNSLRAEDTAVYYCAKDPRRFDYWGQGTLVTVSS

SEQ ID NO: 15162 - protein, 116 aa, Homo sapiens
EVQLLESGGGLVQPGGSLRLSCAASGFTFKAYPIMWVRQAPGKGLEWVSEISPSGEARYYADSVKGRFTISRDNSKNTLYLQMNSLRAEDTAVYYCAKDPRAFDYWGQGTLVTVSS

SEQ ID NO: 15163 - protein, 116 aa, Homo sapiens
EVQLLESGGGLVQPGGSLRLSCAASGFTFRAYPIMWVRQAPGKGLEWVSEISPSGEKRYYADSVKGRFTISRDNSKNTLYLQMNSLRAEDTAVYYCAKDPRAFDYWGQGTLVTVSS

SEQ ID NO: 15164 - protein, 116 aa, Homo sapiens
EVQLLESGGGLVQPGGSLRLSCAASGFTFKAYPIMWVRQAPGKGLEWVSEISPSGEEEYYADSVKGRFTISRDNSKNTLYLQMNSLRAEDTAVYYCAKDPRAFDYWGQGTLVTVSS

SEQ ID NO: 15165 - protein, 116 aa, Homo sapiens
EVQLLESGGGLVQPGGSLRLSCAASGFTFKAYPIMWVRQAPGKGLEWVSEISPSGKKTYYADSVQGRFTISRDNSKNTLYLQMNSLRAEDTAVYYCAKDPRAFDYWGQGTLVTVSS

SEQ ID NO: 15166 - protein, 116 aa, Homo sapiens
EVQLLESGGGLVQPGGSLRLSCAASGFTFKAYPIMWVRQAPGKGLEWVSEISPSGKKKYYADSVKGRFTISRDNSKNTLYLQMNSLRAEDTAVYYCAKDPRAFDYWGQGTLVTVSS

SEQ ID NO: 15167 - protein, 116 aa, Homo sapiens
EVQLLESGGGLVQPGGSLRLSCAASGFTFKAYPIMWVRQAPGKGLEWVSEISPSGGYTYYADSVKGRFTISRDNSKNTLYLQMNSLRAEDTAVYYCAKDPRKFDYWGQGTLVTVSS

SEQ ID NO: 15168 - protein, 116 aa, Homo sapiens
EVQLLESGGGLVQPGGSLRLSCAASGFTFKAYPIMWVRQAPGKGLEWVSEISPSGSYTYYADEVKGRFTISRDNSKNTLYLQMNSLRAEDTAVYYCAKDPRKFDYWGQGTLVTVSS

SEQ ID NO: 15169 - protein, 116 aa, Homo sapiens
EVQLLESGGGLVQPGGSLRLSCAASGFTFKAYPIMWVRQAPGKGLEWVSEISPSGHNKYYADSVKGRFTISRDNSKNTLYLQMNSLRAEDTAVYYCAKDPRRFDYWGQGTLVTVSS

SEQ ID NO: 15170 - protein, 116 aa, Homo sapiens
EVQLLESGGGLVQPGGSLRLSCAASGFTFKAYPIMWVRQAPGKGLEWVSEISPSGSETYYADSVKGRFTISRDNSKNTLYLQMNSLRAEDTAVYYCAKDPRKFDYWGQGTLVTVSS

SEQ ID NO: 15171 - protein, 116 aa, Homo sapiens
EVQLLESGGGLVQPGGSLRLSCAASGFTFKAYPIMWVRQAPGKGLEWVSEISPSGSRTYYADSVKGRFTISRDNSKNTLYLQMNSLRAEDTAVYYCAKDPRKFDYWGQGTLVTVSS

SEQ ID NO: 15172 - protein, 616 aa, Artificial Sequence
  Description of Artificial Sequence: Synthetic polypeptide
  VEGF FvHL
MATGSRTSLLLAFGLLCLPWLQEGSAEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSGGGGSGGGGSGGGGSDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 15173 - protein, 655 aa, Artificial Sequence
  Description of Artificial Sequence: Synthetic polypeptide
  VEGF beta
MATGSRTSLLLAFGLLCLPWLQEGSAEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSGGGGSGGGGSGGGGSDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 15174 - protein, 655 aa, Artificial Sequence
  Description of Artificial Sequence: Synthetic polypeptide
  VEGF LH beta
MATGSRTSLLLAFGLLCLPWLQEGSADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 15175 - protein, 617 aa, Artificial Sequence
  Description of Artificial Sequence: Synthetic polypeptide
  V2 LH alpha
MATGSRTSLLLAFGLLCLPWLQEGSADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSLEADILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 15176 - protein, 656 aa, Artificial Sequence
  Description of Artificial Sequence: Synthetic polypeptide
  V2 LH beta
MATGSRTSLLLAFGLLCLPWLQEGSADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQLEADILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 15177 - protein, 616 aa, Artificial Sequence
  Description of Artificial Sequence: Synthetic polypeptide
  Tom alpha
MATGSRTSLLLAFGLLCLPWLQEGSADILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSAAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSLDDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSS

SEQ ID NO: 15178 - protein, 658 aa, Artificial Sequence
  Description of Artificial Sequence: Synthetic polypeptide
  Tom V2 LH
MATGSRTSLLLAFGLLCLPWLQEGSAGSADILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKRGGGGSGGGGSGGGGSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSAAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQLDDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSS

SEQ ID NO: 15179 - protein, 356 aa, Artificial Sequence
  Description of Artificial Sequence: Synthetic polypeptide
  EGFR alpha
MATGSRTSLLLAFGLLCLPWLQEGSAEVQLVQSGAEVKKPGASVKVSCKASGFSLTNYGVHWMRQAPGQGLEWIGVIWSGGNTDYNTPFTSRVTITSDKSTSTAYMELSSLRSEDTAVYYCARALTYYDYEFAYWGQGTLVTVSSGGGGSGGGGSGGGGSDIQMTQSPSSLSASVGDRVTITCRASQSIGTNIHWYQQKPGKAPKLLIKYASESISGVPSRFSGSGYGTDFTLTISSLQPEDVATYYCQQNNNWPTTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 15180 - protein, 415 aa, Artificial Sequence
  Description of Artificial Sequence: Synthetic polypeptide
  EGFR beta
MATGSRTSLLLAFGLLCLPWLQEGSAEVQLVQSGAEVKKPGASVKVSCKASGFSLTNYGVHWMRQAPGQGLEWIGVIWSGGNTDYNTPFTSRVTITSDKSTSTAYMELSSLRSEDTAVYYCARALTYYDYEFAYWGQGTLVTVSSGGGGSGGGGSGGGGSDIQMTQSPSSLSASVGDRVTITCRASQSIGTNIHWYQQKPGKAPKLLIKYASESISGVPSRFSGSGYGTDFTLTISSLQPEDVATYYCQQNNNWPTTFGQGTKVEIKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 15181 - protein, 618 aa, Artificial Sequence [sequence omitted]

SEQ ID NO: 15182 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTNYSPSLKSRITISVDTSKNQFSLQLSSVTAEDTATYYCARMDYWGQGTLVTVSS

SEQ ID NO: 15183 - protein, 246 aa, Artificial Sequence
  Description of Artificial Sequence: Synthetic polypeptide
  synthetic construct
QVKLQQSGAELVRSGTSVKLSCTASGFNIKDSYMHWLRQGPEQGLEWIGWIDPENGDTEYAPKFQGKATFTTDTSSNTAYLQLSSLTSEDTAVYYCNEGTPTGPYYFDYWGQGTTVTVSSGGGGSGGGGSGGGGSENVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELKRAAAH

SEQ ID NO: 15184 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15185 - protein, 506 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLEEGEFSEARVDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15186 - protein, 498 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLGGDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15187 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15188 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15189 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15190 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15191 - protein, 205 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15192 - protein, 204 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15193 - protein, 205 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYFEFLGSGEAIVLTVPGSERSYDLTGLKPGTEYVVQIIGVKGGHISLPLSAIFTT

SEQ ID NO: 15194 - protein, 205 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFFIRYDEFLRSGEAIVLTVPGSERSYDLTGLKPGTEYWVTILGVKGGLVSTPLSAIFTT

SEQ ID NO: 15195 - protein, 205 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15196 - protein, 205 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYFEFLGSGEAIVLTVPGSERSYDLTGLKPGTEYVVQIIGVKGGHISLPLSAIFTT

SEQ ID NO: 15197 - protein, 194 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15198 - protein, 194 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15199 - protein, 195 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPMLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15200 - protein, 194 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15201 - protein, 194 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15202 - protein, 194 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15203 - protein, 194 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15204 - protein, 194 aa, Artificial Sequence
  Description of Artificial Sequence: Synthetic polypeptide
  bispecific EGFR/cMet binding molecule
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15205 - protein, 194 aa, Artificial Sequence
  Description of Artificial Sequence: Synthetic polypeptide
  bispecific EGFR/cMet binding molecule
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15206 - protein, 194 aa, Artificial Sequence
  Description of Artificial Sequence: Synthetic polypeptide
  bispecific EGFR/cMet binding molecule
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15207 - protein, 194 aa, Artificial Sequence
  Description of Artificial Sequence: Synthetic polypeptide
  bispecific EGFR/cMet binding molecule
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15208 - protein, 194 aa, Artificial Sequence
  Description of Artificial Sequence: Synthetic polypeptide
  bispecific EGFR/cMet binding molecule
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15209 - protein, 194 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15210 - protein, 194 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15211 - protein, 194 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15212 - protein, 194 aa, Artificial Sequence
  Description of Artificial Sequence: Synthetic polypeptide
  bispecific EGFR/cMet binding molecule
MLPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15213 - protein, 250 aa, Artificial Sequence
  Description of Artificial Sequence: Synthetic polypeptide
  Bispecific EGFR/c-Met binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTTAPAPAPAPAPLAEAKVLANRELDKYGVSDYYKNLINNAKTVEGVKALLDEILAALP

SEQ ID NO: 15214 - protein, 250 aa, Artificial Sequence
  Description of Artificial Sequence: Synthetic polypeptide
  Bispecific EGFR/c-Met binding molecule
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTTAPAPAPAPAPLAEAKVLANRELDKYGVSDYYKNLINNAKTVEGVKALLDEILAALP

SEQ ID NO: 15215 - protein, 250 aa, Artificial Sequence
  Description of Artificial Sequence: Synthetic polypeptide
  Bispecific EGFR/c-Met binding molecule
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYFEFLGSGEAIVLTVPGSERSYDLTGLKPGTEYVVNIMGVKGGKISPPLSAIFTTAPAPAPAPAPLAEAKVLANRELDKYGVSDYYKNLINNAKTVEGVKALLDEILAALP

SEQ ID NO: 15216 - protein, 250 aa, Artificial Sequence
  Description of Artificial Sequence: Synthetic polypeptide
  Bispecific EGFR/c-Met binding molecule
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYFEFLGSGEAIVLTVPGSERSYDLTGLKPGTEYVVNIMGVKGGKISPPLSAIFTTAPAPAPAPAPLAEAKVLANRELDKYGVSDYYKNLINNAKTVEGVKALLDEILAALP

SEQ ID NO: 15217 - protein, 204 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15218 - protein, 203 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15219 - protein, 204 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYFEFLGSGEAIVLTVPGSERSYDLTGLKPGTEYVVQIIGVKGGHISLPLSAIFTT

SEQ ID NO: 15220 - protein, 204 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFFIRYDEFLRSGEAIVLTVPGSERSYDLTGLKPGTEYWVTILGVKGGLVSTPLSAIFTT

SEQ ID NO: 15221 - protein, 204 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15222 - protein, 204 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTTGGGGSGGGGSGGGGSGGGGSMLPAPKNLVVSRVTEDSARLSWTAPDAAFDSFWIRYFEFLGSGEAIVLTVPGSERSYDLTGLKPGTEYVVQIIGVKGGHISLPLSAIFTT

SEQ ID NO: 15223 - protein, 193 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15224 - protein, 193 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15225 - protein, 194 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPMLPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15226 - protein, 193 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15227 - protein, 193 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15228 - protein, 193 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15229 - protein, 193 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15230 - protein, 193 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15231 - protein, 193 aa, Artificial Sequence
  Description of Artificial Sequence: Synthetic polypeptide
  Bispecific EGFR/c-Met binding domain
LPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15232 - protein, 193 aa, Artificial Sequence
  Description of Artificial Sequence: Synthetic polypeptide
  Bispecific EGFR/c-Met binding domain
LPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15233 - protein, 193 aa, Artificial Sequence
  Description of Artificial Sequence: Synthetic polypeptide
  Bispecific EGFR/c-Met binding domain
LPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15234 - protein, 193 aa, Artificial Sequence
  Description of Artificial Sequence: Synthetic polypeptide
  Bispecific EGFR/c-Met binding domain
LPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15235 - protein, 193 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15236 - protein, 193 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15237 - protein, 193 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15238 - protein, 193 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15239 - protein, 249 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTTAPAPAPAPAPLAEAKVLANRELDKYGVSDYYKNLINNAKTVEGVKALLDEILAALP

SEQ ID NO: 15240 - protein, 249 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYDEVVVGGEAIVLTVPGSERSYDLTGLKPGTEYYVNILGVKGGSISVPLSAIFTTAPAPAPAPAPLAEAKVLANRELDKYGVSDYYKNLINNAKTVEGVKALLDEILAALP

SEQ ID NO: 15241 - protein, 249 aa, Artificial Sequence
  Description of Artificial Sequence: Synthetic polypeptide
  Bispecific EGFR/c-Met binding domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYFEFLGSGEAIVLTVPGSERSYDLTGLKPGTEYVVNIMGVKGGKISPPLSAIFTTAPAPAPAPAPLAEAKVLANRELDKYGVSDYYKNLINNAKTVEGVKALLDEILAALP

SEQ ID NO: 15242 - protein, 249 aa, Artificial Sequence
  Description of Artificial Sequence: Synthetic polypeptide
  Bispecific EGFR/c-Met binding domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTTAPAPAPAPAPLPAPKNLVVSRVTEDSARLSWTAPDAAFDSFWIRYFEFLGSGEAIVLTVPGSERSYDLTGLKPGTEYVVNIMGVKGGKISPPLSAIFTTAPAPAPAPAPLAEAKVLANRELDKYGVSDYYKNLINNAKTVEGVKALLDEILAALP

SEQ ID NO: 15243 - protein, 195 aa, Artificial Sequence
  Description of Artificial Sequence: Synthetic polypeptide
  Bispecific EGFR/c-Met binding domain
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTTC

SEQ ID NO: 15244 - protein, 195 aa, Artificial Sequence
  Description of Artificial Sequence: Synthetic polypeptide
  Bispecific EGFR/c-Met binding domain
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTTC

SEQ ID NO: 15245 - protein, 195 aa, Artificial Sequence
  Description of Artificial Sequence: Synthetic polypeptide
  Bispecific EGFR/c-Met binding domain
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTTC

SEQ ID NO: 15246 - protein, 195 aa, Artificial Sequence
  Description of Artificial Sequence: Synthetic polypeptide
  Bispecific EGFR/c-Met binding domain
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTTC

SEQ ID NO: 15247 - protein, 195 aa, Artificial Sequence
  Description of Artificial Sequence: Synthetic polypeptide
  Bispecific EGFR/c-Met binding domain
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILGVKGGKISPPLSAIFTTC

SEQ ID NO: 15248 - protein, 195 aa, Artificial Sequence
  Description of Artificial Sequence: Synthetic polypeptide
  Bispecific EGFR/c-Met binding domain
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVGSGEAIVLTVPGSERSYDLTGLKPGTEYVVNILGVKGGSISPPLSAIFTTC

SEQ ID NO: 15249 - protein, 195 aa, Artificial Sequence
  Description of Artificial Sequence: Synthetic polypeptide
  Bispecific EGFR/c-Met binding domain
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFVSKGDAIVLTVPGSERSYDLTGLKPGTEYVVNILGVKGGSISPPLSAIFTTC

SEQ ID NO: 15250 - protein, 195 aa, Artificial Sequence
  Description of Artificial Sequence: Synthetic polypeptide
  Bispecific EGFR/c-Met binding domain
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTTAPAPAPAPAPLPAPKNLVVSRVTEDSARLSWTAPDAAFDSFWIRYFEFLGSGEAIVLTVPGSERSYDLTGLKPGTEYVVNILSVKGGSISPPLSAIFTTC

SEQ ID NO: 15251 - protein, 498 aa, Artificial Sequence
  Description of Artificial Sequence: Synthetic polypeptide
  Synthetic anti-CD3
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQIT

SEQ ID NO: 15252 - protein, 490 aa, Artificial Sequence
  Description of Artificial Sequence: Synthetic polypeptide
  Synthetic anti-CD3
ELVMTQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIKGGGGSGGGGSGGGGSEVQLLEQSGAELVKPGASVKISCKASGYAFTNYWLGWVKQRPGHGLEWIGDLFPGSGNTHYNERFRGKATLTADKSSSTAFMQLSSLTSEDSAVYFCARLRNWDEAMDYWGQGTTVTVSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQIT

SEQ ID NO: 15253 - protein, 496 aa, Artificial Sequence
  Description of Artificial Sequence: Synthetic polypeptide
  Synthetic anti-CD3
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQIT

SEQ ID NO: 15254 - protein, 712 aa, Artificial Sequence
  Description of Artificial Sequence: Synthetic polypeptide
QVQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSEVQLVESGGGLVQPGGSLRLSCAASGYDFTHYGMNWVRQAPGKCLEWVGWINTYTGEPTYAADFKRRFTFSLDTSKSTAYLQMNSLRAEDTAVYYCAKYPYYYGTSHWYFDVWGQGTLVTVSSGGGGSGGGGSGGGGSGGGGSDIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGCGTKVEIK

SEQ ID NO: 15255 - protein, 378 aa, Artificial Sequence
  Description of Artificial Sequence: Synthetic polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSHHHHHH

SEQ ID NO: 15256 - protein, 240 aa, Mus musculus
MEVQLVESGGGLVQPGSLKVSCVTSGFTFSDYYMWVRQTPEKRLEWVAYISQGDITDYPDTVKGRFTISRDNKNTLYLQMSRLKSEDTAMYCARGLDDGAWFAYWGQGTTTVSSGSGGGGSGGGGSGGGSKLDVLMTQIPVSLPVSLGQASISCRSSQIIVHNNGNTLEWYLQKPGQSPQLLIYKVNRFSGVPDRFSGSGSGTDFLKISRVEAEDLGVYYCFQVHVPFTFGSGTKLEIKR

SEQ ID NO: 15257 - protein, 328 aa, Homo sapiens; identical to SEQ ID NO: 10941
  IgG1 constant region

SEQ ID NO: 15258 - protein, 250 aa, Artificial Sequence
  Description of Artificial Sequence: Synthetic polypeptide
  Diabody 5B1CysDb sequence
QSVLTQPPSASGTPGQRVTISCSGSSSNIGSNFVYWYQQLPGTAPKLLIYRNNQRPSGVPDRFSGSRSGTSASLAISGLRSEDEADYYCAAWDDSLGGHYVFGTGTKVTVLSGGGGQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSGSHHHHHHGGC

SEQ ID NO: 15259 - protein, 249 aa, Artificial Sequence
  Description of Artificial Sequence: Synthetic polypeptide
  Diabody 7E3CysDb sequence
DVVLTQSPATLSVSPGERATLSCRASQSVSSNLAWYQQKPQAPRLLIYGASTRATGIPARFSGSGSGTDFTLTISSLQSEDSAVYYCQQYNNWPPYTFGQGTKVDIKSGGGGEVQLVESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSGSHHHHHHGGC

SEQ ID NO: 15260 - protein, 238 aa, Artificial Sequence
  Description of Artificial Sequence: Synthetic polypeptide
DVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSAASTKGPQVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 15261 - protein, 238 aa, Artificial Sequence
  Description of Artificial Sequence: Synthetic polypeptide
QVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSSASTKGPDVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSA

SEQ ID NO: 15262 - protein, 242 aa, Artificial Sequence
  Description of Artificial Sequence: Synthetic polypeptide
DVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSAASTKGPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 15263 - protein, 242 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPDVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSA

SEQ ID NO: 15264 - protein, 243 aa, Artificial Sequence
  Description of Artificial Sequence: Synthetic polypeptide
DVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSAASTKGPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 15265 - protein, 243 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPDVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSA

SEQ ID NO: 15266 - protein, 241 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPDVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSA

SEQ ID NO: 15267 - protein, 238 aa, Artificial Sequence
  Description of Artificial Sequence: Synthetic polypeptide
DVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSAASTKGPEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSS

SEQ ID NO: 15268 - protein, 238 aa, Artificial Sequence
  Description of Artificial Sequence: Synthetic polypeptide
EVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSASTKGPDVQLQESGPGLVKPSQSLSLTCTVTGFSITSPYAWNWIRQFPGNTLEWMGYISYRGSTTHHPSLKSRISITRDTSKNQFFLQLNSVTTEDTATYFCSSYGNYGAYSGQGTLVTVSA

SEQ ID NO: 15269 - protein, 226 aa, Artificial Sequence
  Description of Artificial Sequence: Synthetic polypeptide
DVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKRTVAAPDIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKR

SEQ ID NO: 15270 - protein, 226 aa, Artificial Sequence
  Description of Artificial Sequence: Synthetic polypeptide
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKRTVAAPDVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKR

SEQ ID NO: 15271 - protein, 226 aa, Artificial Sequence
  Description of Artificial Sequence: Synthetic polypeptide
DVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKRTVAAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 15272 - protein, 226 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPDVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKR

SEQ ID NO: 15273 - protein, 225 aa, Artificial Sequence
  Description of Artificial Sequence: Synthetic polypeptide
DVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKRTVAAPQIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 15274 - protein, 225 aa, Artificial Sequence
  Description of Artificial Sequence: Synthetic polypeptide
QIVLSQSPAILSPSPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPDVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKR

SEQ ID NO: 15275 - protein, 225 aa, Artificial Sequence
  Description of Artificial Sequence: Synthetic polypeptide
DVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKRTVAAPQIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINR

SEQ ID NO: 15276 - protein, 225 aa, Artificial Sequence
  Description of Artificial Sequence: Synthetic polypeptide
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEINRTVAAPDVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKR

SEQ ID NO: 15277 - protein, 226 aa, Artificial Sequence
  Description of Artificial Sequence: Synthetic polypeptide
DVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKRTVAAPDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKR

SEQ ID NO: 15278 - protein, 226 aa, Artificial Sequence
  Description of Artificial Sequence: Synthetic polypeptide
DIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKRTVAAPDVLLTQIPLSLPVSLGDQASISCRSSQSIVHSNGNTYLEWYLQKPGQSPKLLIYKVSTRFSGVPDRFSGSGSGTDFTLKISRVEAEDLGVYYCFQGSHVPLTFGAGTQLELKR

SEQ ID NO: 15279 - protein, 217 aa, Homo sapiens
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 15280 - protein, 451 aa, Artificial Sequence
  Description of Artificial Sequence: Synthetic polypeptide
  CH1A1A Fab heavy chain-Fc (hole)
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 15281 - protein, 503 aa, Artificial Sequence; identical to SEQ ID NO: 15188
  Description of Artificial Sequence: Synthetic polypeptide

SEQ ID NO: 15282 - protein, 506 aa, Artificial Sequence; identical to SEQ ID NO: 15185
  Description of Artificial Sequence: Synthetic polypeptide

SEQ ID NO: 15283 - protein, 498 aa, Artificial Sequence; identical to SEQ ID NO: 15186
  Description of Artificial Sequence: Synthetic polypeptide

SEQ ID NO: 15284 - protein, 261 aa, Artificial Sequence
  Description of Artificial Sequence: Synthetic polypeptide
EFATMAVMAPRTLVLLLSGALALTQTWAGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 15285 - protein, 261 aa, Artificial Sequence
  Description of Artificial Sequence: Synthetic polypeptide
EFATMAVMAPRTLVLLLSGALALTQTWAGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPGK

SEQ ID NO: 15286 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPGK

SEQ ID NO: 15287 - protein, 503 aa, Artificial Sequence
  Description of Artificial Sequence: Synthetic polypeptide
EFATMAVMAPRTLVLLLSGALALTQTWAGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGGGSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPGK

SEQ ID NO: 15288 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPGK

SEQ ID NO: 15289 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYDEVVVGGEAIVLTVPGSERSYDLTGLKPGTEYYVNILGVKGGSISVPLSAIFTT

SEQ ID NO: 15290 - protein, 89 aa, Artificial Sequence
  Description of Artificial Sequence: Synthetic polypeptide
  c-Met binding FN3 domain
LPAPKNLVVSRVTEDSARLSWTAPDAAFDSFFIRYDEFLRSGEAIVLTVPGSERSYDLTGLKPGTEYWVTILGVKGGLVSTPLSAIFTT

SEQ ID NO: 15291 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYIVNIMGVKGGSISHPLSAIFTT

SEQ ID NO: 15292 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVNILGVKGGGLSVPLSAIFTT

SEQ ID NO: 15293 - protein, 89 aa, Artificial Sequence
  Description of Artificial Sequence: Synthetic polypeptide
  c-Met binding FN3 domain
LPAPKNLVVSRVTEDSARLSWTAPDAAFDSFVIRYFEFLGSGEAIVLTVPGSERSYDLTGLKPGTEYVVQILGVKGGYISIPLSAIFTT

SEQ ID NO: 15294 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYLEFLLGGEAIVLTVPGSERSYDLTGLKPGTEYVVQIMGVKGGTVSPPLSAIFTT

SEQ ID NO: 15295 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVGINGVKGGYISYPLSAIFTT

SEQ ID NO: 15296 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTDLKPGTEYGVTINGVKGGRVSTPLSAIFTT

SEQ ID NO: 15297 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVQIIGVKGGHISLPLSAIFTT

SEQ ID NO: 15298 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVNIMGVKGGKISPPLSAIFTT

SEQ ID NO: 15299 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYAVNIMGVKGGRVSVPLSAIFTT

SEQ ID NO: 15300 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVQILGVKGGSISVPLSAIFTT

SEQ ID NO: 15301 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVNIMGVKGGSISYPLSAIFTT

SEQ ID NO: 15302 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVQILGVKGGYISIPLSAIFTT

SEQ ID NO: 15303 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVQIMGVKGGTVSPPLSAIFTT

SEQ ID NO: 15304 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFTTAGEAIVLTVPGSERSYDLTGLKPGTEYVVNIMGVKGGSISPPLSAIFTT

SEQ ID NO: 15305 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFELLSTGEAIVLTVPGSERSYDLTGLKPGTEYVVNIMGVKGGSISPPLSAIFTT

SEQ ID NO: 15306 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFVSKGEAIVLTVPGSERSYDLTGLKPGTEYVVNIMGVKGGSISPPLSAIFTT

SEQ ID NO: 15307 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVNILGVKGGKISPPLSAIFTT

SEQ ID NO: 15308 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFVGSGEAIVLTVPGSERSYDLTGLKPGTEYVVNILGVKGGSISPPLSAIFTT

SEQ ID NO: 15309 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFVSKGDAIVLTVPGSERSYDLTGLKPGTEYVVNILGVKGGSISPPLSAIFTT

SEQ ID NO: 15310 - protein, 89 aa, Artificial Sequence
  Description of Artificial Sequence: Synthetic polypeptide
  c-Met binding FN3 domain
LPAPKNLVVSRVTEDSARLSWTAPDAAFDSFWIRYFEFLGSGEAIVLTVPGSERSYDLTGLKPGTEYVVNILSVKGGSISPPLSAIFTT

SEQ ID NO: 15311 - protein, 94 aa, Artificial Sequence
  Description of Artificial Sequence: Synthetic polypeptide
  EGFR binding FN3 domain
LPAPKNLVVSEVTEDSLRLSWADPHGFYDSFLIQYQESEKVGEAINLTVPGSERSYDLTGLKPGTEYTVSIYGVHNVYKDTNMRGLPLSAEFTT

SEQ ID NO: 15312 - protein, 94 aa, Artificial Sequence
  Description of Artificial Sequence: Synthetic polypeptide
  EGFR binding FN3 domain
LPAPKNLVVSEVTEDSLRLSWTYDRDGYDSFLIQYQESEKVGEAINLTVPGSERSYDLTGLKPGTEYTVSIYGVHNVYKDTNMRGLPLSAEFTT

SEQ ID NO: 15313 - protein, 94 aa, Artificial Sequence
  Description of Artificial Sequence: Synthetic polypeptide
  EGFR binding FN3 domain
LPAPKNLVVSEVTEDSLRLSWGYNGDHFDSFLIQYQESEKVGEAINLTVPGSERSYDLTGLKPGTEYTVSIYGVHNVYKDTNMRGLPLSAEFTT

SEQ ID NO: 15314 - protein, 94 aa, Artificial Sequence
  Description of Artificial Sequence: Synthetic polypeptide
  EGFR binding FN3 domain
LPAPKNLVVSEVTEDSLRLSWDDPRGFYESFLIQYQESEKVGEAINLTVPGSERSYDLTGLKPGTEYTVSIYGVHNVYKDTNMRGLPLSAEFTT

SEQ ID NO: 15315 - protein, 94 aa, Artificial Sequence
  Description of Artificial Sequence: Synthetic polypeptide
  EGFR binding FN3 domain
LPAPKNLVVSEVTEDSLRLSWTWPYADLDSFLIQYQESEKVGEAINLTVPGSERSYDLTGLKPGTEYTVSIYGVHNVYKDTNMRGLPLSAEFTT

SEQ ID NO: 15316 - protein, 95 aa, Artificial Sequence
  Description of Artificial Sequence: Synthetic polypeptide
  EGFR binding FN3 domain
LPAPKNLVVSEVTEDSLRLSWDYDLGVYFDSFLIQYQESEKVGEAINLTVPGSERSYDLTGLKPGTEYTVSIYGVHNVYKDTNMRGLPLSAEFTT

SEQ ID NO: 15317 - protein, 94 aa, Artificial Sequence
  Description of Artificial Sequence: Synthetic polypeptide
  EGFR binding FN3 domain
LPAPKNLVVSEVTEDSLRLSWDDPWAFYESFLIQYQESEKVGEAINLTVPGSERSYDLTGLKPGTEYTVSIYGVHNVYKDTNMRGLPLSAEFTT

SEQ ID NO: 15318 - protein, 94 aa, Artificial Sequence
  Description of Artificial Sequence: Synthetic polypeptide
  EGFR binding FN3 domain
LPAPKNLVVSEVTEDSLRLSWTAPDAAFDSFLIQYQESEKVGEAINLTVPGSERSYDLTGLKPGTEYTVSIYGVLGSYVFEHDVMLPLSAEFTT

SEQ ID NO: 15319 - protein, 94 aa, Artificial Sequence
  Description of Artificial Sequence: Synthetic polypeptide
  EGFR binding FN3 domain
LPAPKNLVVSEVTEDSARLSWDDPWAFYESFLIQYQESEKVGEAIVLTVPGSERSYDLTGLKPGTEYTVSIYGVHNVYKDTNMRGLPLSAIFTT

SEQ ID NO: 15320 - protein, 94 aa, Artificial Sequence
  Description of Artificial Sequence: Synthetic polypeptide
  EGFR binding FN3 domain
LPAPKNLVVSEVTEDSARLSWTAPDAAFDSFLIQYQESEKVGEAIVLTVPGSERSYDLTGLKPGTEYTVSIYGVLGSYVFEHDVMLPLSAIFTT

SEQ ID NO: 15321 - protein, 94 aa, Artificial Sequence
  Description of Artificial Sequence: Synthetic polypeptide
  EGFR binding FN3 domain
LPAPKNLVVSEVTEDSARLSWADPHGFYDSFLIQYQESEKVGEAIVLTVPGSERSYDLTGLKPGTEYTVSIYGVHNVYKDTNMRGLPLSAIFTT

SEQ ID NO: 15322 - protein, 94 aa, Artificial Sequence
  Description of Artificial Sequence: Synthetic polypeptide
  EGFR binding FN3 domain
LPAPKNLVVSEVTEDSARLSWDDPWAFYESFLIQYQESEKVGEAIVLTVPGSERSYDLTGLKPGTEYTVSIYGVHNVYKDTNIRGLPLSAIFTT

SEQ ID NO: 15323 - protein, 94 aa, Artificial Sequence
  Description of Artificial Sequence: Synthetic polypeptide
  EGFR binding FN3 domain
LPAPKNLVVSEVTEDSARLSWDDPHAFYESFLIQYQESEKVGEAIVLTVPGSERSYDLTGLKPGTEYTVSIYGVHNVYKDTNIRGLPLSAIFTT

SEQ ID NO: 15324 - protein, 94 aa, Artificial Sequence
  Description of Artificial Sequence: Synthetic polypeptide
  EGFR binding FN3 domain
LPAPKNLVVSEVTEDSARLSWADPHGFYDSFLIQYQESEKVGEAIVLTVPGSERSYDLTGLKPGTEYTVSIYGVHNVYKDTNIRGLPLSAIFTT

SEQ ID NO: 15325 - protein, 95 aa, Artificial Sequence
  Description of Artificial Sequence: Synthetic polypeptide
  EGFR binding FN3 domain
MLPAPKNLVVSEVTEDSLRLSWADPHGFYDSFLIQYQESEKVGEAINLTVPGSERSYDLTGLKPGTEYTVSIYGVHNVYKDTNMRGLPLSAEFTT

SEQ ID NO: 15326 - protein, 95 aa, Artificial Sequence
  Description of Artificial Sequence: Synthetic polypeptide
  EGFR binding FN3 domain
MLPAPKNLVVSEVTEDSLRLSWTYDRDGYDSFLIQYQESEKVGEAINLTVPGSERSYDLTGLKPGTEYTVSIYGVHNVYKDTNMRGLPLSAEFTT

SEQ ID NO: 15327 - protein, 95 aa, Artificial Sequence
  Description of Artificial Sequence: Synthetic polypeptide
  EGFR binding FN3 domain
MLPAPKNLVVSEVTEDSLRLSWGYNGDHFDSFLIQYQESEKVGEAINLTVPGSERSYDLTGLKPGTEYTVSIYGVHNVYKDTNMRGLPLSAEFTT

SEQ ID NO: 15328 - protein, 95 aa, Artificial Sequence
  Description of Artificial Sequence: Synthetic polypeptide
  EGFR binding FN3 domain
MLPAPKNLVVSEVTEDSLRLSWDDPRGFYESFLIQYQESEKVGEAINLTVPGSERSYDLTGLKPGTEYTVSIYGVHNVYKDTNMRGLPLSAEFTT

SEQ ID NO: 15329 - protein, 95 aa, Artificial Sequence
  Description of Artificial Sequence: Synthetic polypeptide
  EGFR binding FN3 domain
MLPAPKNLVVSEVTEDSLRLSWTWPYADLDSFLIQYQESEKVGEAINLTVPGSERSYDLTGLKPGTEYTVSIYGVHNVYKDTNMRGLPLSAEFTT

SEQ ID NO: 15330 - protein, 96 aa, Artificial Sequence
  Description of Artificial Sequence: Synthetic polypeptide
  EGFR binding FN3 domain
MLPAPKNLVVSEVTEDSLRLSWDYDLGVYFDSFLIQYQESEKVGEAINLTVPGSERSYDLTGLKPGTEYTVSIYGVHNVYKDTNMRGLPLSAEFTT

SEQ ID NO: 15331 - protein, 95 aa, Artificial Sequence
  Description of Artificial Sequence: Synthetic polypeptide
  EGFR binding FN3 domain
MLPAPKNLVVSEVTEDSLRLSWDDPWAFYESFLIQYQESEKVGEAINLTVPGSERSYDLTGLKPGTEYTVSIYGVHNVYKDTNMRGLPLSAEFTT

SEQ ID NO: 15332 - protein, 95 aa, Artificial Sequence
  Description of Artificial Sequence: Synthetic polypeptide
  EGFR binding FN3 domain
MLPAPKNLVVSEVTEDSLRLSWTAPDAAFDSFLIQYQESEKVGEAINLTVPGSERSYDLTGLKPGTEYTVSIYGVLGSYVFEHDVMLPLSAEFTT

SEQ ID NO: 15333 - protein, 95 aa, Artificial Sequence
  Description of Artificial Sequence: Synthetic polypeptide
  EGFR binding FN3 domain
MLPAPKNLVVSEVTEDSARLSWDDPWAFYESFLIQYQESEKVGEAIVLTVPGSERSYDLTGLKPGTEYTVSIYGVHNVYKDTNMRGLPLSAIFTT

SEQ ID NO: 15334 - protein, 95 aa, Artificial Sequence
  Description of Artificial Sequence: Synthetic polypeptide
  EGFR binding FN3 domain
MLPAPKNLVVSEVTEDSARLSWTAPDAAFDSFLIQYQESEKVGEAIVLTVPGSERSYDLTGLKPGTEYTVSIYGVLGSYVFEHDVMLPLSAIFTT

SEQ ID NO: 15335 - protein, 95 aa, Artificial Sequence
  Description of Artificial Sequence: Synthetic polypeptide
  EGFR binding FN3 domain
MLPAPKNLVVSEVTEDSARLSWADPHGFYDSFLIQYQESEKVGEAIVLTVPGSERSYDLTGLKPGTEYTVSIYGVHNVYKDTNMRGLPLSAIFTT

SEQ ID NO: 15336 - protein, 95 aa, Artificial Sequence
  Description of Artificial Sequence: Synthetic polypeptide
  EGFR binding FN3 domain
MLPAPKNLVVSEVTEDSARLSWDDPWAFYESFLIQYQESEKVGEAIVLTVPGSERSYDLTGLKPGTEYTVSIYGVHNVYKDTNIRGLPLSAIFTT

SEQ ID NO: 15337 - protein, 95 aa, Artificial Sequence
  Description of Artificial Sequence: Synthetic polypeptide
  EGFR binding FN3 domain
MLPAPKNLVVSEVTEDSARLSWDDPHAFYESFLIQYQESEKVGEAIVLTVPGSERSYDLTGLKPGTEYTVSIYGVHNVYKDTNIRGLPLSAIFTT

SEQ ID NO: 15338 - protein, 95 aa, Artificial Sequence
  Description of Artificial Sequence: Synthetic polypeptide
  EGFR binding FN3 domain
MLPAPKNLVVSEVTEDSARLSWADPHGFYDSFLIQYQESEKVGEAIVLTVPGSERSYDLTGLKPGTEYTVSIYGVHNVYKDTNIRGLPLSAIFTT

SEQ ID NO: 15339 - protein, 513 aa, Homo sapiens
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSIKQIEDKIEEILSKIYHIENEIARIKKLIGERGHDIERKCCVECPPCPEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15340 - protein, 218 aa, Homo Sapiens; identical to SEQ ID NO: 10373

SEQ ID NO: 15341 - protein, 218 aa, Homo Sapiens; identical to SEQ ID NO: 4649

SEQ ID NO: 15342 - protein, 217 aa, Homo Sapiens
PAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15343 - protein, 218 aa, Homo Sapiens
PAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 15344 - protein, 218 aa, Homo Sapiens
PAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWZSNGQPENNYKTTPPVLDSDGSFFLYSRLTVDKSRWQEGNVFSCSVMHEALHNHYTQKSLSLSLGK

SEQ ID NO: 15345 - protein, 215 aa, Mus musculus
TVPEVSSVFIFPPKPKDVLTITLTPKVTCVVVDISKDDPEVQFSWFVDDVEVHTAQTQPREEQFNSTFRSVSELPIMHQDCLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15346 - protein, 218 aa, Mus musculus
PAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 15347 - protein, 218 aa, Mus musculus
PAPNLEGGPSVFIFPPNIKDVLMISLTPKVTCVVVDVSEDDPDVQISWFVNNVEVHTAQTQTHREDYNSTIRVVSHLPIQHQDWMSGKEFKCKVNNKDLPSPIERTISKPKGLVRAPQVYTLPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 15348 - protein, 218 aa, Mus musculus
PPGNILGGPSVFIFPPKPKDALMISLTPKVTCVVVDVSEDDPDVHVSWFVDNKEVHTAWTQPREAQYNSTFRVVSALPIQHQDWMRGKEFKCKVNNKALPAPIERTISKPKGRAQTPQVYTIPPPREQMSKKKVSLTCLVTNFFSEAISVEWERNGELEQDYKNTPPILDSDGTYFLYSKLTVDTDSWLQGEIFTCSVVHEALHNHHTQKNLSRSPGK

SEQ ID NO: 15349 - protein, 444 aa, Artificial Sequence
  Description of Artificial Sequence: Synthetic polypeptide
QVQLQQSGAELVRPGASVKLSCKASGYTFSDFEMHWVKQTPVHGLEWIGDIDPGTGDTAYNLKFKGKATLTTDKSSSTAYMELRSLTSEDSAVYYCTLGAFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15350 - protein, 451 aa, Artificial Sequence
  Description of Artificial Sequence: Synthetic polypeptide
  antibody
EVQLVESGGGLVQPGGSLRLSCAASGYSFTGHWMNWVRQAPGKGLEWVGMIHPSDSETRYNQKFKDRFTISVDKSKNTLYLQMNSLRAEDTAVYYCARGIYFYGTTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15351 - protein, 451 aa, Artificial Sequence
  Description of Artificial Sequence: Synthetic polypeptide
  CD19 (8B8)  parental heavy chain
EVQLQQSGPELVKPGASVKMACKASGYTFTDYIMHWVKQKTGQGLEWIGYINPYNDGSKYTEKFNGKATLTSDKSSITAYMELSSLTSEDSAVYYCARGTYYYGSALFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15352 - protein, 451 aa, Artificial Sequence
  Description of Artificial Sequence: Synthetic polypeptide
  CD19 (8B8-2B03) heavy chain
QVQLVQSGAEVKKPGASVKVSCKASGYTFTDYITHWVRQAPGQGLEWMGYINPYNDGSKYTEKFQGRVTMTSDTSISTAYMELSRLRSDDTAVYYCARGTYYYGPDLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15353 - protein, 451 aa, Artificial Sequence
  Description of Artificial Sequence: Synthetic polypeptide
  CD19 (8B8-2B11) heavy chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15354 - protein, 451 aa, Artificial Sequence
  Description of Artificial Sequence: Synthetic polypeptide
  CD19 (8B8-5A07)  heavy chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15355 - protein, 451 aa, Artificial Sequence; identical to SEQ ID NO: 15353
  Description of Artificial Sequence: Synthetic polypeptide
  CD19 (8B8-5B08)  heavy chain

SEQ ID NO: 15356 - protein, 451 aa, Artificial Sequence
  Description of Artificial Sequence: Synthetic polypeptide
  CD19 (8B8-5D08) heavy chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSELFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15357 - protein, 451 aa, Artificial Sequence; identical to SEQ ID NO: 15354
  Description of Artificial Sequence: Synthetic polypeptide
  CD19 (8B8-5H09)  heavy chain

SEQ ID NO: 15358 - protein, 451 aa, Artificial Sequence; identical to SEQ ID NO: 15356
  Description of Artificial Sequence: Synthetic polypeptide
  CD19 (8B8-7H07) heavy chain

SEQ ID NO: 15359 - protein, 452 aa, Artificial Sequence; identical to SEQ ID NO: 4850
  Description of Artificial Sequence: Synthetic polypeptide
  full length heavy chain sequence

SEQ ID NO: 15360 - protein, 452 aa, Artificial Sequence
  Description of Artificial Sequence: Synthetic polypeptide
  full length heavy chain
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15361 - protein, 452 aa, Artificial Sequence; identical to SEQ ID NO: 4852
  Description of Artificial Sequence: Synthetic polypeptide
  full length heavy chain

SEQ ID NO: 15362 - protein, 452 aa, Artificial Sequence; identical to SEQ ID NO: 4854
  Description of Artificial Sequence: Synthetic polypeptide
  full length heavy chain sequence

SEQ ID NO: 15363 - protein, 452 aa, Artificial Sequence; identical to SEQ ID NO: 4855
  Description of Artificial Sequence: Synthetic polypeptide
  full length heavy chain sequence

SEQ ID NO: 15364 - protein, 452 aa, Artificial Sequence
  Description of Artificial Sequence: Synthetic polypeptide
  full length heavy chain sequence
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSASYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNAALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 15365 - protein, 452 aa, Artificial Sequence; identical to SEQ ID NO: 5578
  Description of Artificial Sequence: Synthetic polypeptide
  full length heavy chain

SEQ ID NO: 15366 - protein, 452 aa, Artificial Sequence
  Description of Artificial Sequence: Synthetic polypeptide
  full length heavy chain
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNAALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15367 - protein, 119 aa, Artificial Sequence [sequence omitted]

SEQ ID NO: 15368 - protein, 122 aa, Artificial Sequence [sequence omitted]

SEQ ID NO: 15369 - protein, 455 aa, Artificial Sequence
  Description of Artificial Sequence: Synthetic polypeptide
  Heavy chain humanized CD3 binder polypeptide
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15370 - protein, 462 aa, Homo sapiens
  MOD_RES (14)..(14): Ala or Pro
  MOD_RES (42)..(42): Glu or Lys
  MOD_RES (97)..(97): Ser or Thr
MDWTWSILFLVAAXTGAHSQVQLVQSGAEVKKPGASVKVSCXASGYTFTSYGFSWVRQAPGQGLEWMGWISASNGNTYYAQKLQGRVTMTTDTSTSXAYMELRSLRSDDTAVYYCARVYADYADYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15371 - protein, 132 aa, Homo sapiens
MDWTWSILFLVAAPTGAHSQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARYSYFWGQGTLVTVSS

SEQ ID NO: 15372 - protein, 443 aa, Mus musculus; identical to SEQ ID NO: 10441

SEQ ID NO: 15373 - protein, 445 aa, Mus musculus; identical to SEQ ID NO: 12635

SEQ ID NO: 15374 - protein, 443 aa, Mus musculus; identical to SEQ ID NO: 10442

SEQ ID NO: 15375 - protein, 446 aa, Mus musculus; identical to SEQ ID NO: 10443

SEQ ID NO: 15376 - protein, 448 aa, Mus musculus; identical to SEQ ID NO: 10444

SEQ ID NO: 15377 - protein, 448 aa, Mus musculus; identical to SEQ ID NO: 10445

SEQ ID NO: 15378 - protein, 448 aa, Mus musculus; identical to SEQ ID NO: 10446

SEQ ID NO: 15379 - protein, 448 aa, Mus musculus; identical to SEQ ID NO: 10447

SEQ ID NO: 15380 - protein, 448 aa, Mus musculus; identical to SEQ ID NO: 10448

SEQ ID NO: 15381 - protein, 448 aa, Mus musculus; identical to SEQ ID NO: 10449

SEQ ID NO: 15382 - protein, 448 aa, Mus musculus; identical to SEQ ID NO: 10450

SEQ ID NO: 15383 - protein, 446 aa, Mus musculus; identical to SEQ ID NO: 10451

SEQ ID NO: 15384 - protein, 447 aa, Mus musculus; identical to SEQ ID NO: 10452

SEQ ID NO: 15385 - protein, 447 aa, Mus musculus; identical to SEQ ID NO: 10453

SEQ ID NO: 15386 - protein, 446 aa, Mus musculus; identical to SEQ ID NO: 10454

SEQ ID NO: 15387 - protein, 446 aa, Mus musculus; identical to SEQ ID NO: 10455

SEQ ID NO: 15388 - protein, 446 aa, Mus musculus; identical to SEQ ID NO: 10456

SEQ ID NO: 15389 - protein, 444 aa, Mus musculus; identical to SEQ ID NO: 10457

SEQ ID NO: 15390 - protein, 448 aa, Mus musculus; identical to SEQ ID NO: 10458

SEQ ID NO: 15391 - protein, 463 aa, Homo sapiens
MKHLWFFLLLVAAPRWVLSQLQLQESGPGLVKPSETLSLTCTVSGGSISSSSYYGGWIRQPPGKGLDWIGSIYYSGNTYYNPSLKSRVTISVDTSKNQFSLKLSSVTAADTAVYYCARHSWDYFDYWDQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15392 - protein, 135 aa, Homo sapiens
MKHLWFFLLLVAAPRWVLSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARSCYFDYWGQGTLVTVSS

SEQ ID NO: 15393 - protein, 462 aa, Homo sapiens
MELGLCWVFLVAILEGVQCEVQLVESGGGLVQPGGSLRLSCAASGFTFSRYSMNWVRQAPGKGLEWVSYISSRSSTIYYADSVKGRFTMSRDNAKNSLYMQMNSLRDEDTAVYYCGYGDYDYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15394 - protein, 136 aa, Homo sapiens
MELGLCWVFLVAILEGVQCEVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARYGDYYFDYWGQGTLVTVSS

SEQ ID NO: 15395 - protein, 480 aa, Homo sapiens
MKHLWFFLLLVAAPRWVLSQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDGPLGYCSSTSCPVTGEYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15396 - protein, 149 aa, Homo sapiens
MKHLWFFLLLVAAPRWVLSQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYCSSTSCTGDYYYYYGMDVWGQGTTVTVSS

SEQ ID NO: 15397 - protein, 440 aa, Artificial Sequence; identical to SEQ ID NO: 10465
  Description of Artificial Sequence: Synthetic polypeptide
  synthetic construct

SEQ ID NO: 15398 - protein, 440 aa, Artificial Sequence; identical to SEQ ID NO: 10465
  Description of Artificial Sequence: Synthetic polypeptide
  synthetic constuct

SEQ ID NO: 15399 - protein, 441 aa, Artificial Sequence; identical to SEQ ID NO: 6768
  Description of Artificial Sequence: Synthetic polypeptide
  synthetic constuct

SEQ ID NO: 15400 - protein, 441 aa, Artificial Sequence; identical to SEQ ID NO: 6768
  Description of Artificial Sequence: Synthetic polypeptide
  synthetic construct

SEQ ID NO: 15401 - protein, 455 aa, Homo Sapiens
EVQLVESGGGLVKPGGSLKLSCAASGFTFSDYYMYWVRQTPEKRLEWVATISDDGSYTYYPDSVKGRFTISRDNAKNNLYLQMSSLKSEDTAMYYCAREGLYYYGSGSYYNQDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 15402 - protein, 449 aa, Homo Sapiens
QVQLVQSGAEVKKPGASVKVSCETSGYTFTSYGISWVRQAPGHGLEWMGWISAYNGYTNYAQKLQGRVTMTTDTSTSTAYMELRSLRSDDTAVYYCARDLRGTNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 15403 - protein, 449 aa, Artificial Sequence; identical to SEQ ID NO: 5159
  Description of Artificial Sequence: Synthetic polypeptide
  synthetic construct

SEQ ID NO: 15404 - protein, 440 aa, Artificial Sequence
  Description of Artificial Sequence: Synthetic polypeptide
  synthetic constuct
EVQLQQSGPELVKPGASVRISCKASGYTFTSRYIHWMKQRPGQGLEWIGWIYPVTGDTYYNEKFKGKATLTSDKSSSTAYMQISSLTSDDSAVYFCARGGGMFYYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15405 - protein, 446 aa, Artificial Sequence
  Description of Artificial Sequence: Synthetic polypeptide
  sequence is synthesized
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELLGGPSVFLFPPKPKDTLMISRTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 15406 - protein, 443 aa, Artificial Sequence
  Description of Artificial Sequence: Synthetic polypeptide
  synthetic construct
EVQLQQSGTVLARPGASVKMSCKASGYSFTSYWMYWVKQRPGQGLEWIGGFHPGNSGTNYNQKFKGKAKLTAVTSASTAYMELSSLTNEDSAVYYCTRGYYYDGSFTYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15407 - protein, 443 aa, Artificial Sequence
  Description of Artificial Sequence: Synthetic polypeptide
  synthetic construct
EVQLQQSGTVLARPGASVKMSCKASGYSFTSYWMYWVKQRPGQGLEWIGGFHPRNSGTNYNQKFKGKAKLTAVTSASTAYMELSSLTNEDSAVYYCTRGYYYDGSFTYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15408 - protein, 442 aa, Artificial Sequence; identical to SEQ ID NO: 10460
  Description of Artificial Sequence: Synthetic polypeptide
  Synthetic (heavy chain of an anti-c-Met antibody)

SEQ ID NO: 15409 - protein, 449 aa, Artificial Sequence; identical to SEQ ID NO: 10575
  Description of Artificial Sequence: Synthetic polypeptide

SEQ ID NO: 15410 - protein, 451 aa, Homo Sapiens
EVQLVESGGGLVQPGGSLRLSCAASGFTFSSYWMNWVRQAPGKGLEWVANIKKDGSEKYYVDSVKGRFTISRDNAKNSLYLQMNSLRAEDTAVYYCARDLGWGWGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 15411 - protein, 455 aa, Homo Sapiens
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 15412 - protein, 451 aa, Artificial Sequence
  Description of Artificial Sequence: Synthetic polypeptide
  huEGFR-8 HC, full-Length Heavy/Light Chain
QVQLVQSGAEVVKPGASVKLSCTTSGFTIKDTYIHWVKKRPGQGLEWIGRIDPTNGNNKYDQKFQGKATITADTSSNTAYLQLSSLTSEDTAVYYCTREDGYRYDDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15413 - protein, 445 aa, Artificial Sequence
  Description of Artificial Sequence: Synthetic polypeptide
  huML66HC, full-Length Heavy/Light Chain
QVQLQESGPGLVKPSETLSLTCTVSGLSLASNSVSWIRQPPGKGLEWMGVIWNHGGTDYNPSIKSRLSISRDTSKSQVFLKMNSLTAADTAMYFCVRKGGIYFDYWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15414 - protein, 222 aa, Artificial Sequence
  Description of Artificial Sequence: Synthetic polypeptide
QVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVP

SEQ ID NO: 15415 - protein, 330 aa, Artificial Sequence; identical to SEQ ID NO: 5349
  Description of Artificial Sequence: Synthetic polypeptide

SEQ ID NO: 15416 - protein, 121 aa, Mus musculus
VQLQESGPGLVKPSQSLSLTCSVTGYSFTNGYYWNWIRQFPGNKLEWMGYISYDGNNSYNPSLKNRISITRDTSKNQFFLKLNSVTTEDTATYYCASHGYYEEDYYAMDYWGQGTSVTVSS

SEQ ID NO: 15417 - protein, 119 aa, Mus musculus
EVKLVESGGGLVKPGGSLKLSCAASGFTFSSFAMSWVRQTPEKRLEWVAVINSNGGITDYPDTVKDRFTISRDNAKNTLYLQMSSLRSEDTALYFCARRGGNYAWFAYWGQGTLVTVSA

SEQ ID NO: 15418 - protein, 119 aa, Mus musculus
QIQLQQSGPELVNPGASVKISCKPSGYTFTDYYINWVKQRPGQGLEWIGWIHPGGGYTKYNEKFRGKATVTVDTSANTVYMQLSSLTSDDSAVYFCARRDYGDYGFAYWGQGTLVTVSA

SEQ ID NO: 15419 - protein, 469 aa, Artificial Sequence
  Description of Artificial Sequence: Synthetic polypeptide
  chemically synthesized
MYRMQLLSCIALSLALVTNSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15420 - protein, 449 aa, Artificial Sequence; identical to SEQ ID NO: 10575
  Description of Artificial Sequence: Synthetic polypeptide
  chemically synthesized

SEQ ID NO: 15421 - protein, 469 aa, Artificial Sequence
  Description of Artificial Sequence: Synthetic polypeptide
  chemically synthesized
MYRMQLLSCIALSLALVTNSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15422 - protein, 449 aa, Artificial Sequence; identical to SEQ ID NO: 10574
  Description of Artificial Sequence: Synthetic polypeptide
  chemically synthesized

SEQ ID NO: 15423 - protein, 449 aa, Artificial Sequence; identical to SEQ ID NO: 10576
  Description of Artificial Sequence: Synthetic polypeptide
  chemically synthesized

SEQ ID NO: 15424 - protein, 129 aa, Homo sapiens; identical to SEQ ID NO: 12043

SEQ ID NO: 15425 - protein, 121 aa, Homo sapiens; identical to SEQ ID NO: 12044

SEQ ID NO: 15426 - protein, 117 aa, Homo sapiens; identical to SEQ ID NO: 12045

SEQ ID NO: 15427 - protein, 121 aa, Homo sapiens; identical to SEQ ID NO: 12046

SEQ ID NO: 15428 - protein, 121 aa, Homo sapiens; identical to SEQ ID NO: 12047

SEQ ID NO: 15429 - protein, 121 aa, Homo sapiens; identical to SEQ ID NO: 12048

SEQ ID NO: 15430 - protein, 123 aa, Homo sapiens; identical to SEQ ID NO: 12049

SEQ ID NO: 15431 - protein, 463 aa, Artificial Sequence
  Description of Artificial Sequence: Synthetic polypeptide
MGWSCIIVLLVSTATGVHSQVQLQQPGAELVRPGTSVKLSCKASGYTFTSHWLHWVKQRPGQGLEWIGVLDPSDFYSNYNQNFKGKATLTVDTSSSTAYMQLSSLTSEDSAVYYCARGLLSGDYAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15432 - protein, 475 aa, Artificial Sequence
  Description of Artificial Sequence: Synthetic polypeptide
MGRLTSSFLLLIVPAYVLSQVTLKESGPGILRPSQTLSLTCSFSGFSLSTFGLSVGWIRQPSGKGLEWLAHIWWDDDKYYNPALKSRLTISKDTSKNQVFLKIANVDTADTATYYCARIGADALPFDYWGQGTTLTVSSAKTTPPSVYPLAPGCGDTTGSSVTSGCLVKGYFPEPVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYTLPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 15433 - protein, 460 aa, Artificial Sequence
  Description of Artificial Sequence: Synthetic polypeptide
MEWSWVSLFFLSVTTGVHSQVQLQQSDAELVKPGASVKISCKVSGYTFTDHIIHWMKQRPEQGLEWIGYIYPRDGYIKYNEKFKGKATLTADKSSSTAYMQVNSLTSEDSAVYFCARGYYYAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15434 - protein, 458 aa, Artificial Sequence
  Description of Artificial Sequence: Synthetic polypeptide
MGWSCIIVLLVSTATCVHSQVQLLQPGAELVRPGTSVKLSCKTSGYTFSSYWMHWVKQRPGQGLEWIGMIDPSDVYTNYNPKFKGKATLTVDTSSSTAYMQLSSLTSEDSAVYYCARNYSGDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15435 - protein, 464 aa, Artificial Sequence
  Description of Artificial Sequence: Synthetic polypeptide
MGWLWNLLFLMAAAQSAQAQIQLVQSGPELKKPGEAVKISCKSSGYTFTTYGMSWVKQAPGRALKWMGWINTYSGVPTYADDFKGRFAFSLESSASTAYLQINNLKNEDTATYFCARGRDGYQVAWFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15436 - protein, 458 aa, Artificial Sequence
  Description of Artificial Sequence: Synthetic polypeptide
MGWSCIIVLLVSTATGVHSQVQLQQPGAELVRPGTSVKLSCKASGYTFTNYWMHWVKQRPGQGLEWIGMIDPSDSYTNYNPKFKGKATLTVDTSSSTAYMQLSSLTSEDSAVYYCARNYSGDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15437 - protein, 462 aa, Artificial Sequence
  Description of Artificial Sequence: Synthetic polypeptide
MNFGLSLMFLVLVLKGVQCEVQLVESGGGLVKPGGSLKLSCAASGFTFSDYAMSWVRQTPEKRLEWVATISDGGTYTYYPDNVKGRFTISRDNAKNNLYLQMSHLKSEDTAMYYCAREWGDYDGFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15438 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15439 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15440 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15441 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15442 - protein, 324 aa, Artificial Sequence
  Description of Artificial Sequence: Synthetic polypeptide
AKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 15443 - protein, 336 aa, Artificial Sequence
  Description of Artificial Sequence: Synthetic polypeptide
AKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 15444 - protein, 451 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15445 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFLFSSYPMHWVRQAPGKGLEWVGSISPSGGATPYADSVKGRFTISRDNSKNTLYLQMNSLRPEDTAVYYCAKDFYNILTGNAFDKWGQGTSVTVSSASTGGGGSGGGGSGGGGSGGGGSDIQLTQSPSSLSASLGDRVTITCRASQGISSYLAWYQQKPGKAPKLLIYAGSTPQSGVPSRFSGSGSGTEFTLTISSLQPEDSGTYYCQQYWTWPLTFGGGTKVEIKRT

SEQ ID NO: 15446 - protein, 471 aa, Artificial Sequence
  Description of Artificial Sequence: Synthetic polypeptide
MDMRVPAQLLGLLLLWLRGARCQVQLVESGGGLVKPGGSLRLSCAASGFTFSDYAMSWIRQAPGKGLEWVSTISDGGTYTYYPDSVKGRFTISRDNAKNSLYLQMNSLRAEDTAVYYCAREWGDYDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15447 - protein, 467 aa, Artificial Sequence
  Description of Artificial Sequence: Synthetic polypeptide
MDMRVPAQLLGLLLLWLRGARCQVQLVESGGGLVKPGGSLRLSCAASGFTFSDYAMSWIRQAPGKGLEWVSTISDGGTYTYYPDSVKGRFTISRDNAKNSLYLQMNSLRAEDTAVYYCAREWGDYDGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15448 - protein, 471 aa, Artificial Sequence
  Description of Artificial Sequence: Synthetic polypeptide
  CHIMERIC IgG1 HC SEQUENCE
MNFGLRLIFLVLTLKGVQCDVQLVESGGDLVKPGGSLKLSCVVSGFTFSTYGMSWVRQTPDRRLEWVATISHGDGYTYYPDSVKGRFTISRDNAKNTLHLQMSSLKSEDTAMYYCARHGDYDDDYYAMDYWGQGTSVTFSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15449 - protein, 467 aa, Artificial Sequence
  Description of Artificial Sequence: Synthetic polypeptide
  CHIMERIC IgG2 HC SEQUENCE
MNFGLRLIFLVLTLKGVQCDVQLVESGGDLVKPGGSLKLSCVVSGFTFSTYGMSWVRQTPDRRLEWVATISHGDGYTYYPDSVKGRFTISRDNAKNTLHLQMSSLKSEDTAMYYCARHGDYDDDYYAMDYWGQGTSVTFSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 15450 - protein, 503 aa, Artificial Sequence
  Description of Artificial Sequence: Synthetic polypeptide
  CHIMERIC IgG3 HC SEQUENCE
MNFGLRLIFLVLTLKGVQCDVQLVESGGDLVKPGGSLKLSCVVSGFTFSTYGMSWVRQTPDRRLEWVATISHGDGYTYYPDSVKGRFTISRDNAKNTLHLQMSSLKSEDTAMYYCARHGDYDDDYYAMDYWGQGTSVTFSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 15451 - protein, 471 aa, Artificial Sequence
  Description of Artificial Sequence: Synthetic polypeptide
  HUMANIZED IgG1 HC SEQUENCE 1
MNFGLRLIFLVLTLKGVQCDVQLVESGGGLVQPGGSLRLSCAASGFTFSTYGMSWVRQTPDKRLEWVATISHGDGYTYYPDSVKGRFTISRDNAKNTLYLQMSSLKSEDTAMYYCARHGDYDDDYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15452 - protein, 471 aa, Artificial Sequence
  Description of Artificial Sequence: Synthetic polypeptide
  HUMANIZED IgG1 HC SEQUENCE 2
MNFGLRLIFLVLTLKGVQCDVQLVESGGGLVQPGGSLRLSCAVSGFTFSTYGMSWVRQAPGKGLEWVATISHGDGYTYYPDSVKGRFTISRDNSKNTLYLQMNSLRAEDTAVYYCARHGDYDDDYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15453 - protein, 471 aa, Artificial Sequence
  Description of Artificial Sequence: Synthetic polypeptide
  HUMANIZED IgG1 HC SEQUENCE 3
MNFGLRLIFLVLTLKGVQCDVQLVESGGDLVKPGGSLKLSCVASGFTFSTYGMSWVRQTPDKRLEWVATISHGDGYTYYPDSVKGRFTISRDNAKNTLYLQMSSLKSEDTAMYYCARHGDYDDDYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15454 - protein, 471 aa, Artificial Sequence
  Description of Artificial Sequence: Synthetic polypeptide
  HUMANIZED IgG1 HC SEQUENCE 4
MNFGLRLIFLVLTLKGVQCDVQLVESGGDLVKPGGSLKLSCVASGFTFSTYGMSWVRQTPDRRLEWVATISHGDGYTYYPDSVKGRFTISRDNAKNTLHLQMSSLKSEDTAMYYCARHGDYDDDYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15455 - protein, 716 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15456 - protein, 739 aa, Artificial Sequence
  Description of Artificial Sequence: Synthetic polypeptide
MGFGLSWLFLVAILKGVQCEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15457 - protein, 739 aa, Artificial Sequence
  Description of Artificial Sequence: Synthetic polypeptide
MGFGLSWLFLVAILKGVQCEVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15458 - protein, 716 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15459 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15460 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 15461 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVSSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15462 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVSSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 15463 - protein, 734 aa, Artificial Sequence
  Description of Artificial Sequence: Synthetic polypeptide
MGFGLSWLFLVAILKGVQCEVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 15464 - protein, 734 aa, Artificial Sequence
  Description of Artificial Sequence: Synthetic polypeptide
MGFGLSWLFLVAILKGVQCEVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 15465 - protein, 739 aa, Artificial Sequence
  Description of Artificial Sequence: Synthetic polypeptide
MGFGLSWLFLVAILKGVQCEVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15466 - protein, 708 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGGGGSGGGGSLQEVQLLESGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTMVTVSSASTGGGGSGGGGSGGGGSDIQMTQSPSSFSASTGDRVTITCRASQGISSYLAWYQQKPGKAPKLLIYAASTLQSGVPSRFSGSGSGTDFTLTISSLQPEDSATYYCQQYFTFPLTFGGGTKVEIK

SEQ ID NO: 15467 - protein, 712 aa, Artificial Sequence [sequence omitted]

SEQ ID NO: 15468 - protein, 711 aa, Artificial Sequence
  Description of Artificial Sequence: Synthetic polypeptide
EVQLLESGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGGGGSGGGGSLQEVQLLESGGGLVQPGGSLRLSCAASGFTFSVYDMYWVRQAPGKGLEWVSYIYSSGGDTDYADSVKGRFTISRDNSKNTLYLQMNSLRAEDTATYYCARASTNSIYDAMDVWGQGTTVTVSSASTGGGGSGGGGSGGGGSDIQMTQSPSSVSASVGDRVTITCRASQDITNWLAWYQQKPGKAPTLLIYDASTLQSGVPSRFSGSGSGTDFTLTISSLQPEDFATYFCQQANGFPLTFGGGTKVEIK

SEQ ID NO: 15469 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 15470 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 15471 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15472 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 15473 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 15474 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15475 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 15476 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 15477 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15478 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 15479 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 15480 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15481 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 15482 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 15483 - protein, 720 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 15484 - protein, 469 aa, Artificial Sequence
  Description of Artificial Sequence: Synthetic polypeptide
  Synthetic sequence: Anti-FAP hu36-IgG1-HC
METDTLLLWVLLLWVPGSTGQVQLVQSGAEVKKPGASVKVSCKASGYTFTENIIHWVRQAPGQGLEWMGWFHPGSGSIKYNEKFKDRVTMTADTSTSTVYMELSSLRSEDTAVYYCARHGGTGRGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15485 - protein, 453 aa, Homo sapiens
VQLQQSGPELVKPGASVKMSCKTSRYTFTEYTIHWVRQSHGKSLEWIGGINPNNGIPNYNQKFKGRATLTVGKSSSTAYMELRSLTSEDSAVYFCARRRIAYGYDEGHAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15486 - protein, 472 aa, Homo sapiens
MGWSWVFLFLLSGTAGVLSEVQLQQSGPELVKPGASVKMSCKTSRYTFTEYTIHWVRQSHGKSLEWIGGINPNNGIPNYNQKFKGRATLTVGKSSSTAYMELRSLTSEDSAVYFCARRRIAYGYDEGHAMDYWGQGTSVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15487 - protein, 472 aa, Homo sapiens
MDWTWRVFCLLAVAPGAHSQVQLVQSGAEVKKPGASVKVSCKTSRYTFTEYTIHWVRQAPGQRLEWIGGINPNNGIPNYNQKFKGRATLTVGKSASTAYMELSSLRSEDTAVYYCARRRIAYGYDEGHAMDYWGQGTLVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15488 - protein, 466 aa, Artificial Sequence
  Description of Artificial Sequence: Synthetic polypeptide
  Chimeric protein comprising fusion of murine and human sequences
MGWSGVFIFILSGTAGVQSQVQLQQSGAELARPGASVNLSCKASGYTFTNNGINWLKQRTGQGLEWIGEIYPRSTNTLYNEKFKGKATLTADRSSNTAYMELRSLTSEDSAVYFCARTLTAPFAFWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15489 - protein, 446 aa, Homo sapiens
  MOD_RES (1)..(1): Pyro-Glu
XVQLVQSGAEVKKPGSSVKVSCKASGGTFSRSAIIWVRQAPGQGLEWMGGIVPMFGPPNYAQKFQGRVTITADESTNTAYMELSSLRSEDTAFYFCAGGYGIYSPEEYNGGLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPQVKFNWYVDGVQVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNDGEPENYKTTPPVLDSDGSFFLYSKLTVDKSRWQEGNVFSCSVMHEALHNHYTQKSLSLSPG

SEQ ID NO: 15490 - protein, 446 aa, Homo sapiens
EVQLVQSGAEVKKPGSSVKVSCKASGGTFSRSAIIWVRQAPGQGLEWMGGIVPMFGPPNYAQKFQGRVTITADESTNTAYMELSSLRSEDTAFYFCAGGYGIYSPEEYNGGLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15491 - protein, 595 aa, Artificial Sequence
  Description of Artificial Sequence: Synthetic polypeptide
  artificial antibody chain
MKLPVRLLVLMFWIPASLSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 15492 - protein, 449 aa, Artificial Sequence
  Description of Artificial Sequence: Synthetic polypeptide
QVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15493 - protein, 449 aa, Artificial Sequence
  Description of Artificial Sequence: Synthetic polypeptide
QVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15494 - protein, 449 aa, Artificial Sequence
  Description of Artificial Sequence: Synthetic polypeptide
QVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15495 - protein, 449 aa, Artificial Sequence; identical to SEQ ID NO: 15492
  Description of Artificial Sequence: Synthetic polypeptide

SEQ ID NO: 15496 - protein, 449 aa, Artificial Sequence; identical to SEQ ID NO: 15493
  Description of Artificial Sequence: Synthetic polypeptide

SEQ ID NO: 15497 - protein, 449 aa, Artificial Sequence; identical to SEQ ID NO: 15494
  Description of Artificial Sequence: Synthetic polypeptide

SEQ ID NO: 15498 - protein, 443 aa, Homo sapiens
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCAVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15499 - protein, 443 aa, Artificial Sequence
  Description of Artificial Sequence: Synthetic polypeptide
  Hu14.18 IgG1 Mature Heavy Chain with K322A Mutation
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCAVSNAALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15500 - protein, 449 aa, Artificial Sequence
  Description of Artificial Sequence: Synthetic polypeptide
  Chimeric 3F8 heavy chain gamma 1
QVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15501 - protein, 448 aa, Artificial Sequence
  Description of Artificial Sequence: Synthetic polypeptide
  huH1 - gamma 1
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15502 - protein, 462 aa, Artificial Sequence
  Description of Artificial Sequence: Synthetic polypeptide
  monoclonal antibody chain
MGWTWIFILILSVTTGVHSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15503 - protein, 462 aa, Artificial Sequence; identical to SEQ ID NO: 15502
  Description of Artificial Sequence: Synthetic polypeptide
  artificial antibody chain

SEQ ID NO: 15504 - protein, 448 aa, Artificial Sequence; identical to SEQ ID NO: 15501
  Description of Artificial Sequence: Synthetic polypeptide
  huH1 - gamma 1

SEQ ID NO: 15505 - protein, 448 aa, Artificial Sequence
  Description of Artificial Sequence: Synthetic polypeptide
  huH2 - gamma 1
QVQLKESGPGVVQPGQSLSISCAVSGFSVTNYGVHWVRQPPGKGLEWLGVIWAGGITNYNSAFMSRLTISKDNSKSTVYLKMNSLQAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15506 - protein, 446 aa, Artificial Sequence
  Description of Artificial Sequence: Synthetic polypeptide
  huH1-gamma 4
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15507 - protein, 449 aa, Artificial Sequence
  Description of Artificial Sequence: Synthetic polypeptide
  huH3-gamma 1, with stability enhanced mutations
QVQLVESGPGLVQPGRSLRLTCAVSGFSVTNYGVHWVRQPPGKGLEWLGVIWAGGITNYNSAFMSRLTISKDNSKNTVYLQMNSLRAEDTAVYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15508 - protein, 450 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15509 - protein, 707 aa, Artificial Sequence
  Description of Artificial Sequence: Synthetic polypeptide
  humanized   H-chain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLVESGGGLVKPGGSLRLSCAASGFTFSDYAMSWIRQAPGKGLEWVSSINIGATYIYYADSVKGRFTISRDNAKNSLYLQMNSLRAEDTAVYYCARPGSPYEYDKAYYSMAYWGQGTTVTVSSGGGGSGGGGSGGGGSDIQMTQSPSSLSASVGDRVTITCRASQDIKNYLNWYQQKPGKAPKLLIYYSSTLLSGVPSRFSGSGSGTDFTLTISSLQPEDFATYYCQQSITLPPTFGGGTKVEIK

SEQ ID NO: 15510 - protein, 712 aa, Artificial Sequence
  Description of Artificial Sequence: Synthetic polypeptide
  humanized   H-chain, disulfide-stabilized
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLVESGGGLVKPGGSLRLSCAASGFTFSDYAMSWIRQAPGKCLEWVSSINIGATYIYYADSVKGRFTISRDNAKNSLYLQMNSLRAEDTAVYYCARPGSPYEYDKAYYSMAYWGQGTTVTVSSGGGGSGGGGSGGGGSGGGGSDIQMTQSPSSLSASVGDRVTITCRASQDIKNYLNWYQQKPGKAPKLLIYYSSTLLSGVPSRFSGSGSGTDFTLTISSLQPEDFATYYCQQSITLPPTFGCGTKVEIK

SEQ ID NO: 15511 - protein, 457 aa, Homo Sapiens
QVQLVQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGKGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSRLTVDKSRWQQGNVFSCSVMHEALHNHYTQKSLSLSPGK

SEQ ID NO: 15512 - protein, 457 aa, Homo Sapiens
QVQLVQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGKGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLLYSKLTVDKSRWQQGNVFSCSVMHEALHNHYTQKSLSLSPGK

SEQ ID NO: 15513 - protein, 449 aa, Artificial Sequence; identical to SEQ ID NO: 5020
  Description of Artificial Sequence: Synthetic polypeptide
  Synthetic: antibody A heavy chain

SEQ ID NO: 15514 - protein, 451 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15515 - protein, 451 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15516 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 15517 - protein, 451 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15518 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVSSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 15519 - protein, 451 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15520 - protein, 705 aa, Artificial Sequence
  Description of Artificial Sequence: Synthetic polypeptide
  humanized   H-chain
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLVESGGGLVKPGGSLRLSCAASGFTFSDYAMSWIRQAPGKGLEWVSSINIGATYIYYADSVKGRFTISRDNAKNSLYLQMNSLRAEDTAVYYCARPGSPYEYDKAYYSMAYWGQGTTVTVSSGGGGSGGGGSGGGGSDIQMTQSPSSLSASVGDRVTITCRASQDIKNYLNWYQQKPGKAPKLLIYYSSTLLSGVPSRFSGSGSGTDFTLTISSLQPEDFATYYCQQSITLPPTFGGGTKVEIK

SEQ ID NO: 15521 - protein, 705 aa, Artificial Sequence
  Description of Artificial Sequence: Synthetic polypeptide
  humanized   H-chain, disulfide-stabilized
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLVESGGGLVKPGGSLRLSCAASGFTFSDYAMSWIRQAPGKCLEWVSSINIGATYIYYADSVKGRFTISRDNAKNSLYLQMNSLRAEDTAVYYCARPGSPYEYDKAYYSMAYWGQGTTVTVSSGGGGSGGGGSGGGGSDIQMTQSPSSLSASVGDRVTITCRASQDIKNYLNWYQQKPGKAPKLLIYYSSTLLSGVPSRFSGSGSGTDFTLTISSLQPEDFATYYCQQSITLPPTFGCGTKVEIK

SEQ ID NO: 15522 - protein, 720 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15523 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 15524 - protein, 720 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 15525 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 15526 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 15527 - protein, 715 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 15528 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15529 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 15530 - protein, 720 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 15531 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 15532 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 15533 - protein, 715 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 15534 - protein, 720 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15535 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 15536 - protein, 720 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 15537 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 15538 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 15539 - protein, 715 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 15540 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 15541 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 15542 - protein, 720 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 15543 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 15544 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 15545 - protein, 715 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSEVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 15546 - protein, 475 aa, Mus musculus
MYLGLNYVFIVFLLNGVQSEVKLEESGGGLVQPGGSMKLSCAASGFTFSDAWMNWVRQSPEKGLEWVAEIRSKVINPAIYYAESVKERFTILRDDSKSSVYLQMNSLRAEDTGIYYCSRSTMITTRDPSRYFDVWGAGTTVTVSSATTTAPSVYPLVPGCSDTSGSSVTLGCLVKGYFPEPVTVKWNYGALSSGVRTVSSVLQSGFYSLSSLVTVPSSTWPSQTVICNVAHPASKTELIKRIEPRIPKPSTPPGSSCPPGNILGGPSVFIFPPKPKDALMISLTPKVTCVVVDVSEDDPDVHVSWFVDNKEVHTAWTQPREAQYNSTFRVVSALPIQHQDWMRGKEFKCKVNNKALPAPIERTISKPKGRAQTPQVYTIPPPREQMSKKKVSLTCLVTNFFSEAISVEWERNGELEQDYKNTPPILDSDGTYFLYSKLTVDTDSWLQGEIFTCSVVHEALHNHHTQKNLSRSPGK

SEQ ID NO: 15547 - protein, 475 aa, Homo sapiens
MYLGLNCVFIVFLLNGVQSEVKLEESGGGLVQPGGSMKLSCAASGFTFSDAWMNWVRQSPEKGLEWVAEIRSKVINPAIYYAESVKERFTILRDDSKSSVYLQMNSLRAEDTGIYYCSRSTMITTRDPSRYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15548 - protein, 475 aa, Homo sapiens
MYLGLNYVFIVFLLNGVQSEVKLEESGGGLVQPGGSMKLSCVASGFTFSDAWMNWVRQSPEKGLEWVAEIRSKAINPAIYYAESVKGRFTILRDDSKSSVYLQMNSLRAEDTGIYYCSRSTMITTRDPSRYFDVWGAGTTVTVSSATTTAPSVYPLVPGCSDTSGSSVTLGCLVKGYFPEPVTVKWNYGALSSGVRTVSSVLQSGFYSLSSLVTVPSSTWPSQTVICNVAHPASKTELIKRIEPRIPKPSTPPGSSCPPGNILGGPSVFIFPPKPKDALMISLTPKVTCVVVDVSEDDPDVHVSWFVDNKEVHTAWTQPREAQYNSTFRVVSALPIQHQDWMRGKEFKCKVNNKALPAPIERTISKPKGRAQTPQVYTIPPPREQMSKKKVSLTCLVTNFFSEAISVEWERNGELEQDYKNTPPILDSDGTYFLYSKLTVDTDSWLQGEIFTCSVVHEALHNHHTQKNLSRSPGK

SEQ ID NO: 15549 - protein, 486 aa, Homo sapiens
EVKLEESGGGLVQPGGSMKLSCVASGFTFSDAWMNWVRQSPEKGLEWVAEIRSKAINPAIYYAESVKGRFTILRDDSKSSVYLQMNSLRAEDTGIYYCSRSTMITTRDPSRYFDVWGAGTTVTVSSASTKGPSVFPLAPSSKSTVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15550 - protein, 449 aa, Artificial Sequence
  Description of Artificial Sequence: Synthetic polypeptide
  Human/Murine Chimera G193 Heavy Chain
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15551 - protein, 442 aa, Artificial Sequence
  Description of Artificial Sequence: Synthetic polypeptide
  Synthetic Heavy chain  MCSP clone M4-3 (C1) polypeptide
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15552 - protein, 458 aa, Artificial Sequence
  Description of Artificial Sequence: Synthetic polypeptide
  73R009 Heavy chain amino acid sequence with predicted signal sequence
MKHLWFFLLLVAAPRWVLSQVQLQESGPGLVKPSETLSLTCTVTGTTITASYAWSWIRQPPGKGLEWMGYISYSGGTDYNPSLKSRITISRDTFKNQFSLKLSSVTAADTATYYCARKGAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15553 - protein, 458 aa, Artificial Sequence
  Description of Artificial Sequence: Synthetic polypeptide
  73R009 (13A variant) Heavy chain amino acid sequence with predicted signal sequence
MKHLWFFLLLVAAPRWVLSQVQLQESGPGLVKPSETLSLTCTVTGTTITASYAWSWIRQPPGKGLEWMGYISYSGGTDYNPSLKSRITISRDTFKNQFSLKLSSVTAADTATYYCARKGAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 15554 - protein, 439 aa, Artificial Sequence
  Description of Artificial Sequence: Synthetic polypeptide
  73R009 (13A variant) Heavy chain amino acid sequence without predicted signal sequence
QVQLQESGPGLVKPSETLSLTCTVTGTTITASYAWSWIRQPPGKGLEWMGYISYSGGTDYNPSLKSRITISRDTFKNQFSLKLSSVTAADTATYYCARKGAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 15555 - protein, 439 aa, Artificial Sequence
  Description of Artificial Sequence: Synthetic polypeptide
  73R009 (13B variant) Heavy chain amino acid sequence without signal sequence
QVQLQESGPGLVKPSETLSLTCTVTGTTITASYAWSWIRQPPGKGLEWMGYISYSGGTDYNPSLKSRITISRDTFKNQFSLKLSSVTAADTATYYCARKGAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVEGFYPSDIAVEWESNGQPENNYKTTPPMLDSDGSFFLYSELTVDKSRWQQGNVFSCSVMHEALHNHYTQKSLSLSPGK

SEQ ID NO: 15556 - protein, 439 aa, Artificial Sequence
  Description of Artificial Sequence: Synthetic polypeptide
  73R009 Heavy chain amino acid sequence without predicted signal sequence
QVQLQESGPGLVKPSETLSLTCTVTGTTITASYAWSWIRQPPGKGLEWMGYISYSGGTDYNPSLKSRITISRDTFKNQFSLKLSSVTAADTATYYCARKGAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15557 - protein, 461 aa, Artificial Sequence; identical to SEQ ID NO: 10802
  Description of Artificial Sequence: Synthetic polypeptide
  AntiMET-R heavy chain

SEQ ID NO: 15558 - protein, 449 aa, Artificial Sequence
  Description of Artificial Sequence: Synthetic polypeptide
  Chimeric Cricetulus migratorius and Human
QVQLQQSGAELVKPGASVRLSCKTSGYTFTTHYVSWVKQKPGQGLEWIGWIFGGSARTNYNQKFQGKATLTVDTSSSTAYMDLRSLTSDDSAVYFCVRQVGWDDALDFWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15559 - protein, 449 aa, Artificial Sequence; identical to SEQ ID NO: 5175
  Description of Artificial Sequence: Synthetic polypeptide

SEQ ID NO: 15560 - protein, 453 aa, Artificial Sequence
  Description of Artificial Sequence: Synthetic polypeptide
  Caninised anti-NGF VH canine IgG-A heavy chain (caN-HCA)
EVQLVESGGDLVNPGGTLTLSCVVSGFSLTNNNVNWVRQALGRGLEWVGGVWAGGATDYNSALKSRLTITRDTSKSTVFLKMHSLQSEDTATYYCARDGGYSSSTLYAMDAWGQGTLVTVSSASTTAPSVFPLAPSCGSTSGSTVALACLVSGYFPEPVTVSWNSGSLTSGVHTFPSVLQSSGLHSLSSMVTVPSSRWPSETFTCNVVHPASNTKVDKPVFNECRCTDTPPCPVPEPLGGPSVLIFPPKPKDILRITRTPEVTCVVLDLGREDPEVQISWFVDGKEVHTAKTQSREQQFNGTYRVVSVLPIEHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHETLQNHYTDLSLSHSPGK

SEQ ID NO: 15561 - protein, 457 aa, Artificial Sequence
  Description of Artificial Sequence: Synthetic polypeptide
  Caninised anti-NGF VH canine IgG-B heavy chain (caN-HCB)
EVQLVESGGDLVNPGGTLTLSCVVSGFSLTNNNVNWVRQALGRGLEWVGGVWAGGATDYNSALKSRLTITRDTSKSTVFLKMHSLQSEDTATYYCARDGGYSSSTLYAMDAWGQGTLVTVSSASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFYPPDIDVEWQSNGQQEPESKYRTTPPQLDEDGSYFLYSKLSVDKSRWQRGDTFICAVMHEALHNHYTQESLSHSPGK

SEQ ID NO: 15562 - protein, 455 aa, Artificial Sequence
  Description of Artificial Sequence: Synthetic polypeptide
  Caninised anti-NGF VH canine IgG-C heavy chain (caN-HCC)
EVQLVESGGDLVNPGGTLTLSCVVSGFSLTNNNVNWVRQALGRGLEWVGGVWAGGATDYNSALKSRLTITRDTSKSTVFLKMHSLQSEDTATYYCARDGGYSSSTLYAMDAWGQGTLVTVSSASTTAPSVFPLAPSCGSQSGSTVALACLVSGYIPEPVTVSWNSVSLTSGVHTFPSVLQSSGLYSLSSMVTVPSSRWPSETFTCNVAHPATNTKVDKPVAKECECKCNCNNCPCPGCGLLGGPSVFIFPPKPKDILVTARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 15563 - protein, 453 aa, Artificial Sequence
  Description of Artificial Sequence: Synthetic polypeptide
  Caninised anti-NGF VH canine IgG-D heavy chain (caN-HCD)
EVQLVESGGDLVNPGGTLTLSCVVSGFSLTNNNVNWVRQALGRGLEWVGGVWAGGATDYNSALKSRLTITRDTSKSTVFLKMHSLQSEDTATYYCARDGGYSSSTLYAMDAWGQGTLVTVSSASTTAPSVFPLAPSCGSTSGSTVALACLVSGYFPEPVTVSWNSGSLTSGVHTFPSVLQSSGLYSLSSTVTVPSSRWPSETFTCNVVHPASNTKVDKPVPKESTCKCISPCPVPESLGGPSVFIFPPKPKDILRITRTPEITCVVLDLGREDPEVQISWFVDGKEVHTAKTQPREQQFNSTYRVVSVLPIEHQDWLTGKEFKCRVNHIGLPSPIERTISKARGQAHQPSVYVLPPSPKELSSSDTVTLTCLIKDFYPPEIDVEWQSNGQPEPESKYHTTAPQLDEDGSYFLYSKLSVDKSRWQQGDTFTCAVMHEALQNHYTDLSLSHSPGK

SEQ ID NO: 15564 - protein, 457 aa, Artificial Sequence
  Description of Artificial Sequence: Synthetic polypeptide
  Caninised anti-NGF VH Aglycosyl canine immunoglobulin heavy chain type B (caN-HCB)
EVQLVESGGDLVNPGGTLTLSCVVSGFSLTNNNVNWVRQALGRGLEWVGGVWAGGATDYNSALKSRLTITRDTSKSTVFLKMHSLQSEDTATYYCARDGGYSSSTLYAMDAWGQGTLVTVSSASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFAGTYRVVSVLPIGHQDWLKGKQFTCKVNNKALPSPIERTISKARGQAHQPSVYVLPPSREELSKNTVSLTCLIKDFYPPDIDVEWQSNGQQEPESKYRTTPPQLDEDGSYFLYSKLSVDKSRWQRGDTFICAVMHEALHNHYTQESLSHSPGK

SEQ ID NO: 15565 - protein, 455 aa, Artificial Sequence
  Description of Artificial Sequence: Synthetic polypeptide
  Caninised anti-NGF VH aglycosyl canine immunoglobulin heavy chain type C (caN-HCC)
EVQLVESGGDLVNPGGTLTLSCVVSGFSLTNNNVNWVRQALGRGLEWVGGVWAGGATDYNSALKSRLTITRDTSKSTVFLKMHSLQSEDTATYYCARDGGYSSSTLYAMDAWGQGTLVTVSSASTTAPSVFPLAPSCGSQSGSTVALACLVSGYIPEPVTVSWNSVSLTSGVHTFPSVLQSSGLYSLSSMVTVPSSRWPSETFTCNVAHPATNTKVDKPVAKECECKCNCNNCPCPGCGLLGGPSVFIFPPKPKDILVTARTPTVTCVVVDLDPENPEVQISWFVDSKQVQTANTQPREEQSAGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 15566 - protein, 444 aa, Artificial Sequence
  Description of Artificial Sequence: Synthetic polypeptide
QVQLQQSGAELASPGASVKLSCKASGYTFTTYWLQWVKQRPGQGLEWIGAIYPGPGNTKYTQKFKDKATLTADKSASTAYMQLNSLTSEDSAVYYCARRGSRRGIAYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15567 - protein, 444 aa, Artificial Sequence
  Description of Artificial Sequence: Synthetic polypeptide
QVQLVQSGAELKKPGASVKLSCKASGYTFTTYWLQWVRQAPGQGLEWMGAIYPGPGNTKYTQKFKDRFTITADTSKSTAYMQLNSLKSEDSAVYYCARRGSRRGIAYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15568 - protein, 444 aa, Artificial Sequence
  Description of Artificial Sequence: Synthetic polypeptide
QVQLVQSGAEVKKPGASVKVSCKASGYTFTTYWLQWVRQAPGQGLEWMGAIYPGPGNTKYTQKFKDRVTITADESTSTAYMELSSLRSEDTAVYYCARRGSRRGIAYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15569 - protein, 444 aa, Artificial Sequence
  Description of Artificial Sequence: Synthetic polypeptide
QVQLVQSGAELKKPGASVKLSCKASGYTFTTYWLQWVRQAPGQGLEWMGAIYPGPGNTKYTQKFKDRFTITADKSKSTAYMQLNSLKSEDSAVYYCARRGSRRGIAYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15570 - protein, 444 aa, Artificial Sequence
  Description of Artificial Sequence: Synthetic polypeptide
QVQLVQSGAELVQPGASVKLSCKASGYTFTTYWLQWVRQTPGQGLEWMGAIYPGPGNTKYTQKFKDRVTITADTSTSTAYMQLNSLRSEDSAVYYCARRGSRRGIAYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 15571 - protein, 326 aa, Artificial Sequence; identical to SEQ ID NO: 3049
  Description of Artificial Sequence: Synthetic polypeptide

SEQ ID NO: 15572 - protein, 467 aa, Artificial Sequence; identical to SEQ ID NO: 7292
  Description of Artificial Sequence: Synthetic polypeptide
  Synthetic alpha-RANKL-1 heavy chain

SEQ ID NO: 15573 - protein, 518 aa, Artificial Sequence [sequence omitted]

SEQ ID NO: 15574 - protein, 446 aa, Artificial Sequence
  Description of Artificial Sequence: Synthetic polypeptide
QVQLQQSDAELVKPGASVKISCKASGYTFTDHAIHWVKQKPEQGLDWIGYISPGNGDIKYNEKFKDKVTLTADKSSSTACMHLNSLTSEDSAVYFCKRSLLALDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 15575 - protein, 466 aa, Artificial Sequence
  Description of Artificial Sequence: Synthetic polypeptide
  Chi-83D4 Heavy Chain
TMEWRWVFLFFLSVTTGVHSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15576 - protein, 122 aa, Artificial Sequence
  Description of Artificial Sequence: Synthetic polypeptide
EVQLVESGGGLVKPGGSLRLSCAASGFSFSNNDVMCWVRQAPGKGLEWIGCIMTTDVVTEYANWAKSRFTVSRDSAKNSVYLQMNSLRAEDTAVYFCARDSVGSPLMSFDLWGPGTLVTVSS

SEQ ID NO: 15577 - protein, 123 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYSSSWYYWYFDLWGRGTLVTVSS

SEQ ID NO: 15578 - protein, 120 aa, Artificial Sequence
  Description of Artificial Sequence: Synthetic polypeptide
EVQLVESGGGLVQPGGSLRLSCAASGFTISDYWLHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 15579 - protein, 330 aa, Artificial Sequence; identical to SEQ ID NO: 3051
  Description of Artificial Sequence: Synthetic polypeptide
  Synthetic IgG1 HC constant region

SEQ ID NO: 15580 - protein, 326 aa, Artificial Sequence; identical to SEQ ID NO: 3049
  Description of Artificial Sequence: Synthetic polypeptide
  Synthetic IgG2 HC constant region

SEQ ID NO: 15581 - protein, 377 aa, Artificial Sequence
  Description of Artificial Sequence: Synthetic polypeptide
  Synthetic IgG3 HC constant region
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15582 - protein, 327 aa, Artificial Sequence; identical to SEQ ID NO: 5342
  Description of Artificial Sequence: Synthetic polypeptide
  Synthetic IgG4 HC constant region

SEQ ID NO: 15583 - protein, 330 aa, Artificial Sequence
  Description of Artificial Sequence: Synthetic polypeptide
  Synthetic IgG1 HC constant region, HJ C to S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15584 - protein, 330 aa, Artificial Sequence
  Description of Artificial Sequence: Synthetic polypeptide
  Synthetic IgG1 HC constant region, HJ C to V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15585 - protein, 330 aa, Artificial Sequence
  Description of Artificial Sequence: Synthetic polypeptide
  Synthetic IgG1 HC constant region, BJ C to S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15586 - protein, 330 aa, Artificial Sequence
  Description of Artificial Sequence: Synthetic polypeptide
  Synthetic IgG1 HC constant region, BJ C to V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15587 - protein, 330 aa, Artificial Sequence
  Description of Artificial Sequence: Synthetic polypeptide
  Synthetic IgG1 HC constant region, DJ C to S
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15588 - protein, 330 aa, Artificial Sequence
  Description of Artificial Sequence: Synthetic polypeptide
  Synthetic IgG1 HC constant region, DJ C to V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15589 - protein, 330 aa, Artificial Sequence
  Description of Artificial Sequence: Synthetic polypeptide
  Synthetic IgG1 HC constant region, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15590 - protein, 330 aa, Artificial Sequence
  Description of Artificial Sequence: Synthetic polypeptide
  Synthetic IgG1 HC constant region, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15591 - protein, 330 aa, Artificial Sequence; identical to SEQ ID NO: 10965
  Description of Artificial Sequence: Synthetic polypeptide
  Synthetic IgG1 HC constant region, L117A and L118A

SEQ ID NO: 15592 - protein, 330 aa, Artificial Sequence
  Description of Artificial Sequence: Synthetic polypeptide
  Synthetic IgG1 HC constant region, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15593 - protein, 330 aa, Artificial Sequence
  Description of Artificial Sequence: Synthetic polypeptide
  Synthetic IgG1 HC constant region, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15594 - protein, 330 aa, Artificial Sequence
  Description of Artificial Sequence: Synthetic polypeptide
  Synthetic IgG1 HC constant region, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15595 - protein, 377 aa, Artificial Sequence
  Description of Artificial Sequence: Synthetic polypeptide
  Synthetic IgG3 HC constant region, L164A
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPEALGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15596 - protein, 377 aa, Artificial Sequence
  Description of Artificial Sequence: Synthetic polypeptide
  Synthetic IgG3 HC constant region, L165A
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELAGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15597 - protein, 377 aa, Artificial Sequence
  Description of Artificial Sequence: Synthetic polypeptide
  Synthetic IgG3 HC constant region, L164A and L165A
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPEAAGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15598 - protein, 377 aa, Artificial Sequence
  Description of Artificial Sequence: Synthetic polypeptide
  Synthetic IgG3 HC constant region, L164G and L165G
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPEGGGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15599 - protein, 377 aa, Artificial Sequence
  Description of Artificial Sequence: Synthetic polypeptide
  Synthetic IgG3 HC constant region, L164V and L165V
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPEVVGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15600 - protein, 377 aa, Artificial Sequence
  Description of Artificial Sequence: Synthetic polypeptide
  Synthetic IgG3 HC constant region, L164I and L165I
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPEIIGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKTKGQPREPQVYTLPPSREEMTKNQVSLTCLVKGFYPSDIAVEWESSGQPENNYKTTPPVLDSDGSFFLYSKLTVDKSRWQQGNIFSCSVMHEALHNHFTQKSLSLSPGK

SEQ ID NO: 15601 - protein, 327 aa, Artificial Sequence
  Description of Artificial Sequence: Synthetic polypeptide
  Synthetic IgG4 HC constant region, L115A
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15602 - protein, 327 aa, Artificial Sequence
  Description of Artificial Sequence: Synthetic polypeptide
  Synthetic IgG4 HC constant region, L115G
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15603 - protein, 327 aa, Artificial Sequence
  Description of Artificial Sequence: Synthetic polypeptide
  Synthetic IgG4 HC constant region, L115V
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFVGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15604 - protein, 327 aa, Artificial Sequence
  Description of Artificial Sequence: Synthetic polypeptide
  Synthetic IgG4 HC constant region, L115I
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFIGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15605 - protein, 330 aa, Artificial Sequence
  Description of Artificial Sequence: Synthetic polypeptide
  Synthetic IgG1 HC constant region, HJ C to S, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15606 - protein, 330 aa, Artificial Sequence
  Description of Artificial Sequence: Synthetic polypeptide
  Synthetic IgG1 HC constant region, HJ C to S, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15607 - protein, 330 aa, Artificial Sequence
  Description of Artificial Sequence: Synthetic polypeptide
  Synthetic IgG1 HC constant region, HJ C to S, L117A and L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15608 - protein, 330 aa, Artificial Sequence
  Description of Artificial Sequence: Synthetic polypeptide
  Synthetic IgG1 HC constant region, HJ C to S, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15609 - protein, 330 aa, Artificial Sequence
  Description of Artificial Sequence: Synthetic polypeptide
  Synthetic IgG1 HC constant region, HJ C to S, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15610 - protein, 330 aa, Artificial Sequence
  Description of Artificial Sequence: Synthetic polypeptide
  Synthetic IgG1 HC constant region, HJ C to S, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTCPPCPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15611 - protein, 330 aa, Artificial Sequence
  Description of Artificial Sequence: Synthetic polypeptide
  Synthetic IgG1 HC constant region, HJ C to V, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15612 - protein, 330 aa, Artificial Sequence
  Description of Artificial Sequence: Synthetic polypeptide
  Synthetic IgG1 HC constant region, HJ C to V, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15613 - protein, 330 aa, Artificial Sequence
  Description of Artificial Sequence: Synthetic polypeptide
  Synthetic IgG1 HC constant region, HJ C to V, L117A and L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15614 - protein, 330 aa, Artificial Sequence
  Description of Artificial Sequence: Synthetic polypeptide
  Synthetic IgG1 HC constant region, HJ C to V, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15615 - protein, 330 aa, Artificial Sequence
  Description of Artificial Sequence: Synthetic polypeptide
  Synthetic IgG1 HC constant region, HJ C to V, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15616 - protein, 330 aa, Artificial Sequence
  Description of Artificial Sequence: Synthetic polypeptide
  Synthetic IgG1 HC constant region, HJ C to V, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTCPPCPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15617 - protein, 330 aa, Artificial Sequence
  Description of Artificial Sequence: Synthetic polypeptide
  Synthetic IgG1 HC constant region, BJ C to S, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15618 - protein, 330 aa, Artificial Sequence
  Description of Artificial Sequence: Synthetic polypeptide
  Synthetic IgG1 HC constant region, BJ C to S, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15619 - protein, 330 aa, Artificial Sequence
  Description of Artificial Sequence: Synthetic polypeptide
  Synthetic IgG1 HC constant region, BJ C to S, L117A and L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15620 - protein, 330 aa, Artificial Sequence
  Description of Artificial Sequence: Synthetic polypeptide
  Synthetic IgG1 HC constant region, BJ C to S, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15621 - protein, 330 aa, Artificial Sequence
  Description of Artificial Sequence: Synthetic polypeptide
  Synthetic IgG1 HC constant region, BJ C to S, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15622 - protein, 330 aa, Artificial Sequence
  Description of Artificial Sequence: Synthetic polypeptide
  Synthetic IgG1 HC constant region, BJ C to S, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15623 - protein, 330 aa, Artificial Sequence
  Description of Artificial Sequence: Synthetic polypeptide
  Synthetic IgG1 HC constant region, BJ C to V, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15624 - protein, 330 aa, Artificial Sequence
  Description of Artificial Sequence: Synthetic polypeptide
  Synthetic IgG1 HC constant region, BJ C to V, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15625 - protein, 330 aa, Artificial Sequence
  Description of Artificial Sequence: Synthetic polypeptide
  Synthetic IgG1 HC constant region, BJ C to V, L117A and L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15626 - protein, 330 aa, Artificial Sequence
  Description of Artificial Sequence: Synthetic polypeptide
  Synthetic IgG1 HC constant region, BJ C to V, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15627 - protein, 330 aa, Artificial Sequence
  Description of Artificial Sequence: Synthetic polypeptide
  Synthetic IgG1 HC constant region, BJ C to V, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15628 - protein, 330 aa, Artificial Sequence
  Description of Artificial Sequence: Synthetic polypeptide
  Synthetic IgG1 HC constant region, BJ C to V, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTVPPVPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15629 - protein, 330 aa, Artificial Sequence
  Description of Artificial Sequence: Synthetic polypeptide
  Synthetic IgG1 HC constant region, DJ C to S, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15630 - protein, 330 aa, Artificial Sequence
  Description of Artificial Sequence: Synthetic polypeptide
  Synthetic IgG1 HC constant region, DJ C to S, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15631 - protein, 330 aa, Artificial Sequence
  Description of Artificial Sequence: Synthetic polypeptide
  Synthetic IgG1 HC constant region, DJ C to S, L117A and L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15632 - protein, 330 aa, Artificial Sequence
  Description of Artificial Sequence: Synthetic polypeptide
  Synthetic IgG1 HC constant region, DJ C to S, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15633 - protein, 330 aa, Artificial Sequence
  Description of Artificial Sequence: Synthetic polypeptide
  Synthetic IgG1 HC constant region, DJ C to S, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15634 - protein, 330 aa, Artificial Sequence
  Description of Artificial Sequence: Synthetic polypeptide
  Synthetic IgG1 HC constant region, DJ C to S, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSSDKTHTSPPSPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15635 - protein, 330 aa, Artificial Sequence
  Description of Artificial Sequence: Synthetic polypeptide
  Synthetic IgG1 HC constant region, DJ C to V, L117A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPEALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15636 - protein, 330 aa, Artificial Sequence
  Description of Artificial Sequence: Synthetic polypeptide
  Synthetic IgG1 HC constant region, DJ C to V, L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPELAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15637 - protein, 330 aa, Artificial Sequence
  Description of Artificial Sequence: Synthetic polypeptide
  Synthetic IgG1 HC constant region, DJ C to V, L117A and L118A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15638 - protein, 330 aa, Artificial Sequence
  Description of Artificial Sequence: Synthetic polypeptide
  Synthetic IgG1 HC constant region, DJ C to V, L117G and L118G
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPEGGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15639 - protein, 330 aa, Artificial Sequence
  Description of Artificial Sequence: Synthetic polypeptide
  Synthetic IgG1 HC constant region, DJ C to V, L117V and L118V
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPEVVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15640 - protein, 330 aa, Artificial Sequence
  Description of Artificial Sequence: Synthetic polypeptide
  Synthetic IgG1 HC constant region, DJ C to V, L117I and L118I
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSVDKTHTVPPVPAPEIIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15641 - protein, 449 aa, Artificial Sequence; identical to SEQ ID NO: 5159
  Description of Artificial Sequence: Synthetic polypeptide

SEQ ID NO: 15642 - protein, 445 aa, Artificial Sequence; identical to SEQ ID NO: 4963
  Description of Artificial Sequence: Synthetic polypeptide

SEQ ID NO: 15643 - protein, 449 aa, Artificial Sequence; identical to SEQ ID NO: 15500
  Description of Artificial Sequence: Synthetic polypeptide
  chimeric Ch3F8 heavy chain-gamma 1

SEQ ID NO: 15644 - protein, 449 aa, Artificial Sequence
  Description of Artificial Sequence: Synthetic polypeptide
  humanized Hu3F8 heavy chain-gamma1
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15645 - protein, 446 aa, Artificial Sequence
  Description of Artificial Sequence: Synthetic polypeptide
  Chimeric Ch3F8 heavy chain-gamma4
QVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 15646 - protein, 446 aa, Artificial Sequence; identical to SEQ ID NO: 15506
  Description of Artificial Sequence: Synthetic polypeptide
  humanized Hu3F8 heavy chain-gamma4

SEQ ID NO: 15647 - protein, 449 aa, Artificial Sequence; identical to SEQ ID NO: 15500
  Description of Artificial Sequence: Synthetic polypeptide
  Chimeric 3F8 heavy chain gamma 1

SEQ ID NO: 15648 - protein, 446 aa, Artificial Sequence; identical to SEQ ID NO: 15645
  Description of Artificial Sequence: Synthetic polypeptide
  Chimeric 3F8 heavy chain gamma 4

SEQ ID NO: 15649 - protein, 446 aa, Artificial Sequence; identical to SEQ ID NO: 15645
  Description of Artificial Sequence: Synthetic polypeptide
  Chimeric 3F8 heavy chain gamma 4

SEQ ID NO: 15650 - protein, 448 aa, Artificial Sequence; identical to SEQ ID NO: 15505
  Description of Artificial Sequence: Synthetic polypeptide
  huH2 - gamma 1

SEQ ID NO: 15651 - protein, 446 aa, Artificial Sequence; identical to SEQ ID NO: 15506
  Description of Artificial Sequence: Synthetic polypeptide
  huH1-gamma 4

SEQ ID NO: 15652 - protein, 449 aa, Artificial Sequence; identical to SEQ ID NO: 15507
  Description of Artificial Sequence: Synthetic polypeptide
  huH3-gamma 1, with stability enhanced mutations

SEQ ID NO: 15653 - protein, 569 aa, Homo sapiens
EVQLVESGGGLVQPGGSLRLSCAASGFTVSGSYMSWVRQAPGKGLEWVSVIYSGGSTYYADSVKGRFTISRDNSKNTLYLQMNSLRAEDTAVYYCARDLRGSYDYWGQGTLVIVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 15654 - protein, 454 aa, Homo sapiens
  heavy chain
QVQLVESGGGVVQPGRSLRLSCAASGFTFSNFGMHWVRQAPGKGLEWVAYISSGGSSINYADTVKGRFTISRDNSKNTLYLQMNSLRAEDTAVYYCTRGGTGTRSLYYFDYWGQGTTVTVSSDIPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15655 - protein, 454 aa, Homo sapiens
  heavy chain
DVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVSSDIPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15656 - protein, 447 aa, Artificial Sequence; identical to SEQ ID NO: 10992
  Description of Artificial Sequence: Synthetic polypeptide
  immunoglobulin heavy chain

SEQ ID NO: 15657 - protein, 449 aa, Artificial Sequence; identical to SEQ ID NO: 15558
  Description of Artificial Sequence: Synthetic polypeptide
  Artificial Chimeric Cricetulus migratorius and Human

SEQ ID NO: 15658 - protein, 443 aa, Artificial Sequence
  Description of Artificial Sequence: Synthetic polypeptide
EVQLLESGGGLVQPGGSLRLSCAASGFTFNNTYMSWVRQAPGKGLEWVSGIYPKSGTTDYADSVKGRFTISRDNSKNTLYLQMNSLRAEDTAVYYCARFRVLFDYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELLGGPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15659 - protein, 443 aa, Artificial Sequence
  Description of Artificial Sequence: Synthetic polypeptide
EVQLLESGGGLVQPGGSLRLSCAASGFTFSGSAMSWVRQAPGKGLEWVSLIRPSRGVTNYADSVKGRFTISRDNSKNTLYLQMNSLRAEDTAVYYCARRGFWFDYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELLGGPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15660 - protein, 373 aa, Artificial Sequence
  Description of Artificial Sequence: Synthetic polypeptide
EVQLLESGGGLVQPGGSLRLSCAASGFTFSGSGMSWVRQAPGKGLEWVSSIWPEGGYTYYADSVKGRFTISRDNSKNTLYLQMNSLRAEDTAVYYCARFVFLFDYWGQGTLVTVSSASTKGPSVFPLAPLSSWTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15661 - protein, 376 aa, Artificial Sequence
  Description of Artificial Sequence: Synthetic polypeptide
EVQLLESGGGLVQPGGSLRLSCAASGFTFNDNYMSWVRQAPGKGLEWVSSIRSGGGVTRYADSVKGRFTISRDNSKNTLYLQMNSLRAEDTAVYYCARHHYSVQGGLDYWGQGTLVTVSSASTKGPSVFPLAPLSSWTVPSSSLGTQTYICNVNHKPSNTKVDKKVEPKSCDKTHTCPPCPALFPPKPKDTLMISRTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15662 - protein, 373 aa, Artificial Sequence
  Description of Artificial Sequence: Synthetic polypeptide
EVQLLESGGGLVQPGGSLRLSCAASGFTFSNNAMSWVRQAPGKGLEWVSAISGSGGSTYYADSVKGRFTISRDNSKNTLYLQMNSLRAEDTAVYYCARHFLLFDYWGQGTLVTVSSASTKGPSVFPLAPLSSWTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15663 - protein, 376 aa, Artificial Sequence
  Description of Artificial Sequence: Synthetic polypeptide
EVQLLESGGGLVQPGGSLRLSCAASGFTFSDYYMSWVRQAPGKGLEWVSSIASSDGYTNYADSVKGRFTISRDNSKNTLYLQMNSLRAEDTAVYYCARSYAYQYRGLDYWGQGTLVTVSSASTKGPSVFPLAPLSSWTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15664 - protein, 374 aa, Artificial Sequence
  Description of Artificial Sequence: Synthetic polypeptide
EVQLLESGGGLVQPGGSLRLSCAASGFTVTRSVIWWVRQAPGKGLEWVSGIGPGGGWTRYADSVKGRFTISRDNSKNTLYLQMNSLRAEDTAVYYCARSIGRRVFDYWGQGTLVTVSSASTKGPSVFPLAPLSSWTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15665 - protein, 446 aa, Artificial Sequence
  Description of Artificial Sequence: Synthetic polypeptide
EVQLLESGGGLVQPGGSLRLSCAASGFTFTGSTMNWVRQAPGKGLEWVSRIGPEGGGTDYADSVKGRFTISRDNSKNTLYLQMNSLRAEDTAVYYCARGIIIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15666 - protein, 373 aa, Artificial Sequence
  Description of Artificial Sequence: Synthetic polypeptide
EVQLLESGGGLVQPGGSLRLSCAASGFTFSDYYMSWVRQAPGKGLEWVSGIGPGGGWTRYADSVKGRFTISRDNSKNTLYLQMNSLRAEDTAVYYCARSIGRRVFDYGQGTLVTVSSASTKGPSVFPLAPLSSWTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15667 - protein, 376 aa, Artificial Sequence; identical to SEQ ID NO: 15663
  Description of Artificial Sequence: Synthetic polypeptide

SEQ ID NO: 15668 - protein, 446 aa, Artificial Sequence
  Description of Artificial Sequence: Synthetic polypeptide
EVQLLESGGGLVQPGGSLRLSCEASGFTFSSNSMSWVRQAPGKGLEWVSSITPSNSATYYADSVKGRFTISRDNSKNTLYLQMNSLRAEDTAVYYCARRAFWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15669 - protein, 446 aa, Artificial Sequence
  Description of Artificial Sequence: Synthetic polypeptide
EVQLLESGGGLVQPGGSLRLSCAASGFTFNRTDMSWVRQAPGKGLEWVSGINSYGGATNYADSVKGRFTISRDNSKNTLYLQMNSLRAEDTAVYYCARRGLWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15670 - protein, 443 aa, Artificial Sequence
  Description of Artificial Sequence: Synthetic polypeptide
EVQLLESGGGLVQPGGSLRLSCAASGFTFTRSAMSWVRQAPGKGLEWVSSISPNSWTNYADSVKGRFTISRDNSKNTLYLQMNSLRAEDTAVYYCARRGLVFDYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15671 - protein, 380 aa, Artificial Sequence
  Description of Artificial Sequence: Synthetic polypeptide
EVQLLESGGGLVQPGGSLRLSCAASGFTFSSYRMNWVRQAPGKGLEWVSVISPGGGWTNYADSVKGRFTISRDNSKNTLYLQMNSLRAEDTAVYYCARTSTSSDYYYYGLDYWGQGTLVTVSSASTKGPSVFPLAPLSSVVTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15672 - protein, 373 aa, Artificial Sequence
  Description of Artificial Sequence: Synthetic polypeptide
EVQLLESGGGLVQPGGSLRLSCEASGFTFSSNSMSWVRQAPGKGLEWVSSITPSNSATYYADSVKGRFTISRDNSKNTLYLQMNSLRAEDTAVYYCARRAFWFDYWGQGTLVTVSSASTKGPSVFPLAPLSSWTVPSSSLGTQTYICNVNHKPSNTKVDKKVEPKSCDKTHTCPPCPALFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNLHNHYTQKSLSLSPGK

SEQ ID NO: 15673 - protein, 215 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15674 - protein, 216 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15675 - protein, 220 aa, Artificial Sequence
  Description of Artificial Sequence: Synthetic polypeptide
EVQLLESGGGLVQPGGSLRLSCAASGFTFSAYGMGWVRQAPGKGLEWVSYISPSGGHTKYADSVKGRFTISRDNSKNTLYLQMNSLRAEDTAVYYCAKVLETGLLVDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15676 - protein, 216 aa, Artificial Sequence
  Description of Artificial Sequence: Synthetic polypeptide
EVQLLESGGGLVQPGGSLRLSCAASGFTFSWYGMGWVRQAPGKGLEWVSYISPSGGITVYADSVKGRFTISRDNSKNTLYLQMNSLRAEDTAVYYCARLNYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15677 - protein, 216 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15678 - protein, 217 aa, Artificial Sequence
  Description of Artificial Sequence: Synthetic polypeptide
EVQLLESGGGLVQPGGSLRLSCAASGFTFSRYGMWWVRQAPGKGLEWVSYIGSSGGPTYYVDSVKGRFTISRDNSKNTLYLQMNSLRAEDTAVYYCAGGRGTPYYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15679 - protein, 218 aa, Artificial Sequence
  Description of Artificial Sequence: Synthetic polypeptide
EVQLLESGGGLVQPGGSLRLSCAASGFTFSIYRMQWVRQAPGKGLEWVSGISPSGGTTWYADSVKGRFTISRDNSKNTLYLQMNSLRAEDTAVYYCARWSGGSGYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15680 - protein, 222 aa, Artificial Sequence
  Description of Artificial Sequence: Synthetic polypeptide
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15681 - protein, 228 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15682 - protein, 223 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15683 - protein, 217 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 15684 - protein, 331 aa, Artificial Sequence
  Description of Artificial Sequence: Synthetic polypeptide
  Canine immunoglobulin heavy chain type A Fc domain (HCA)
ASTTAPSVFPLAPSCGSTSGSTVALACLVSGYFPEPVTVSWNSGSLTSGVHTFPSVLQSSGLHSLSSMVTVPSSRWPSETFTCNVVHPASNTKVDKPVFNECRCTDTPPCPVPEPLGGPSVLIFPPKPKDILRITRTPEVTCVVLDLGREDPEVQISWFVDGKEVHTAKTQSREQQFNGTYRVVSVLPIEHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHETLQNHYTDLSLSHSPGK

SEQ ID NO: 15685 - protein, 335 aa, Artificial Sequence
  Description of Artificial Sequence: Synthetic polypeptide
  Canine immunoglobulin heavy chain type B Fc domain (HCB)
ASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFYPPDIDVEWQSNGQQEPESKYRTTPPQLDEDGSYFLYSKLSVDKSRWQRGDTFICAVMHEALHNHYTQESLSHSPGK

SEQ ID NO: 15686 - protein, 333 aa, Artificial Sequence
  Description of Artificial Sequence: Synthetic polypeptide
  Canine immunoglobulin heavy chain type C Fc domain (HCC)
ASTTAPSVFPLAPSCGSQSGSTVALACLVSGYIPEPVTVSWNSVSLTSGVHTFPSVLQSSGLYSLSSMVTVPSSRWPSETFTCNVAHPATNTKVDKPVAKECECKCNCNNCPCPGCGLLGGPSVFIFPPKPKDILVTARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 15687 - protein, 331 aa, Artificial Sequence
  Description of Artificial Sequence: Synthetic polypeptide
  Canine immunoglobulin heavy chain type D Fc domain (HCD)
ASTTAPSVFPLAPSCGSTSGSTVALACLVSGYFPEPVTVSWNSGSLTSGVHTFPSVLQSSGLYSLSSTVTVPSSRWPSETFTCNVVHPASNTKVDKPVPKESTCKCISPCPVPESLGGPSVFIFPPKPKDILRITRTPEITCVVLDLGREDPEVQISWFVDGKEVHTAKTQPREQQFNSTYRVVSVLPIEHQDWLTGKEFKCRVNHIGLPSPIERTISKARGQAHQPSVYVLPPSPKELSSSDTVTLTCLIKDFYPPEIDVEWQSNGQPEPESKYHTTAPQLDEDGSYFLYSKLSVDKSRWQQGDTFTCAVMHEALQNHYTDLSLSHSPGK

SEQ ID NO: 15688 - protein, 331 aa, Artificial Sequence
  Description of Artificial Sequence: Synthetic polypeptide
  Aglycosyl canine immunoglobulin heavy chain type A Fc domain (HCA)
ASTTAPSVFPLAPSCGSTSGSTVALACLVSGYFPEPVTVSWNSGSLTSGVHTFPSVLQSSGLHSLSSMVTVPSSRWPSETFTCNVVHPASNTKVDKPVFNECRCTDTPPCPVPEPLGGPSVLIFPPKPKDILRITRTPEVTCVVLDLGREDPEVQISWFVDGKEVHTAKTQSREQQFAGTYRVVSVLPIEHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHETLQNHYTDLSLSHSPGK

SEQ ID NO: 15689 - protein, 335 aa, Artificial Sequence
  Description of Artificial Sequence: Synthetic polypeptide
  Aglycosyl caninised immunoglobulin heavy chain type B Fc domain (HCB)
ASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFAGTYRVVSVLPIGHQDWLKGKQFTCKVNNKALPSPIERTISKARGQAHQPSVYVLPPSREELSKNTVSLTCLIKDFYPPDIDVEWQSNGQQEPESKYRTTPPQLDEDGSYFLYSKLSVDKSRWQRGDTFICAVMHEALHNHYTQESLSHSPGK

SEQ ID NO: 15690 - protein, 333 aa, Artificial Sequence
  Description of Artificial Sequence: Synthetic polypeptide
  Aglycosyl canine immunoglobulin heavy chain type C Fc domain (HCC)
ASTTAPSVFPLAPSCGSQSGSTVALACLVSGYIPEPVTVSWNSVSLTSGVHTFPSVLQSSGLYSLSSMVTVPSSRWPSETFTCNVAHPATNTKVDKPVAKECECKCNCNNCPCPGCGLLGGPSVFIFPPKPKDILVTARTPTVTCVVVDLDPENPEVQISWFVDSKQVQTANTQPREEQSAGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 15691 - protein, 331 aa, Artificial Sequence
  Description of Artificial Sequence: Synthetic polypeptide
  Canine immunoglobulin heavy chain type D Fc domain (HCD
  )
ASTTAPSVFPLAPSCGSTSGSTVALACLVSGYFPEPVTVSWNSGSLTSGVHTFPSVLQSSGLYSLSSTVTVPSSRWPSETFTCNVVHPASNTKVDKPVPKESTCKCISPCPVPESLGGPSVFIFPPKPKDILRITRTPEITCVVLDLGREDPEVQISWFVDGKEVHTAKTQPREQQFASTYRVVSVLPIEHQDWLTGKEFKCRVNHIGLPSPIERTISKARGQAHQPSVYVLPPSPKELSSSDTVTLTCLIKDFYPPEIDVEWQSNGQPEPESKYHTTAPQLDEDGSYFLYSKLSVDKSRWQQGDTFTCAVMHEALQNHYTDLSLSHSPGK

SEQ ID NO: 15692 - protein, 330 aa, Artificial Sequence; identical to SEQ ID NO: 3050
  Description of Artificial Sequence: Synthetic polypeptide
  a heavy chain constant region (CH1~CH3)

SEQ ID NO: 15693 - protein, 330 aa, Mus musculus; identical to SEQ ID NO: 10477

SEQ ID NO: 15694 - protein, 330 aa, Homo sapiens; identical to SEQ ID NO: 5349

SEQ ID NO: 15695 - protein, 330 aa, Homo sapiens [sequence omitted]

SEQ ID NO: 15696 - protein, 326 aa, Homo sapiens; identical to SEQ ID NO: 3049

SEQ ID NO: 15697 - protein, 377 aa, Homo sapiens; identical to SEQ ID NO: 5341

SEQ ID NO: 15698 - protein, 327 aa, Homo sapiens; identical to SEQ ID NO: 5342

SEQ ID NO: 15699 - protein, 328 aa, Homo Sapiens; identical to SEQ ID NO: 10941

SEQ ID NO: 15700 - protein, 116 aa, Mus sp.
SGPGILQPSQTLSLTCSFSGFSLYTFDMGVGWIRQPSGKGLEWLAHIWWDDDKYYNPALKSRLTVSKDTSKNQVFLKIPNVDTADSATYYCARVRGLHDYYYWFAYWGQGTLVTVS

SEQ ID NO: 15701 - protein, 116 aa, Mus sp.
SGPGILQPSQTLSLTCSFSGFSLYTFDMGVGWIRQPSGKGLEWLAQIWWDDDKYYNPGLKSRLTISKDTSKNQVFLKIPNVDTADSATYYCARIRGLRDYYYWFAYWGQGTLVTVS

SEQ ID NO: 15702 - protein, 117 aa, Mus sp.
SGPGILQPSQTLSLTCSFSGFSLSTFGLGVGWIRQPSGKGLEWLAHIWWDDDKSYNPALKSRLTISKDTSKNQVFLMIANVDTADTATYYCARIGPKWSNYYYYCDYWGQGTTLTVS

SEQ ID NO: 15703 - protein, 117 aa, Mus sp.
SGPGILQPSQTLSLTCSFSGFSLSTFGLGVGWIRQPSGKGLEWLAHIWWDDDKSYNPALKSQLTISKDTSKNQVLLKIANVDTADTATYYCARIGPKWSNYYYYCDYWGQGTTLTVS

SEQ ID NO: 15704 - protein, 119 aa, Mus musculus; identical to SEQ ID NO: 11860

SEQ ID NO: 15705 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARELPYYRMSKVMDVQGQGTLVTVSS

SEQ ID NO: 15706 - protein, 118 aa, Artificial Sequence
  Description of Artificial Sequence: Synthetic polypeptide
EVQLVQSGAEVKKPGESLKISCKGSGYSFTTYWMHWVRQMPGKGLEWMGEINPTNGHTNYNPSFQGQVTISADKSISTAYLQWSSLKASDTAMYYCARNYVGSIFDYWGQGTLVTVSS

SEQ ID NO: 15707 - protein, 116 aa, Artificial Sequence
  Description of Artificial Sequence: Synthetic polypeptide
EVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSS

SEQ ID NO: 15708 - protein, 121 aa, Artificial Sequence
  Description of Artificial Sequence: Synthetic polypeptide
QVTLKESGPGILQPSQTLSLTCSFSGFSLSTSNMGIGWIRQPSGKGLEWLAHIWWHDDKYYNPSLKSRLTISKDISNNQVFLKITSVDTADTATYYCAQVPFYYGTSFDVWGTGTTVTVSS

SEQ ID NO: 15709 - protein, 121 aa, Artificial Sequence
  Description of Artificial Sequence: Synthetic polypeptide
QVTLKESGPGILQPSQTLSLTCSFSGFSLSTFGMGVGWIRQPSGKGLEWLAHIWWDDDKYYNPALKSRLTISKDTSKNQVFLKIANVDTADTATYYCARIAYYYGSERDYWGQGTTLTVSS

SEQ ID NO: 15710 - protein, 112 aa, Artificial Sequence
  Description of Artificial Sequence: Synthetic polypeptide
QVQLKESGPGLVAPSQSLSITCTVSGFSLTSYGVSWVRQPPGKGLEWLGVIWGDGSTNYHSSLISRLSISKDNSKSQVFLKLNSLQTDDTATYYCARAFVYWGQGTLVTVSA

SEQ ID NO: 15711 - protein, 112 aa, Artificial Sequence
  Description of Artificial Sequence: Synthetic polypeptide
QVQLKESGPGLVAPSQSLSITCTVSGFSLTSYGVSWVRQPPGKGLEWLGVIWGDGSTNYHSALISRLIISKDNSKSQVFLKLNSLQTDDTATYYCTKGFTYWGQGTLVTVSA

SEQ ID NO: 15712 - protein, 112 aa, Artificial Sequence
  Description of Artificial Sequence: Synthetic polypeptide
QVQLQESGPGLVAPSQSLSITCTVSGFSLISYGVNWVRQPPGKGLEWLGVIWGDGSTNYQSALISRLIISKDNSKSQVFLKLNSLQTDDTATYYCTKGFAYWGQGTLVTVSA

SEQ ID NO: 15713 - protein, 112 aa, Artificial Sequence
  Description of Artificial Sequence: Synthetic polypeptide
QVQLKESGPGLVAPSQNLSITCTVSGFSLTSYGVNWVRQPPGKGLEWLGVIWGDGSTNYHSALISRLIISKENSKSQVFLKLNSLQTNDTATYYCTKGFVYWGQGTLVTVSA

SEQ ID NO: 15714 - protein, 114 aa, Artificial Sequence
  Description of Artificial Sequence: Synthetic polypeptide
QVQLKESGPGLVAPSQSLSITCTVSGFSLTSYGVSWVRQPPGKGLEWLGVIWGDGSTNYHSALISRLSISKDNSKSQVFLKLNSLQTDDTATYYCAKGGYFDYWGQGTTLTVSS

SEQ ID NO: 15715 - protein, 129 aa, Artificial Sequence
  Description of Artificial Sequence: Synthetic polypeptide
  Amino acid sequence identified using molecular biology technique
VKLVESGPGLVAPSQSLSITCTVSGFSLTTHGVNWVRQPPGKGLEWLGVIWDDGNINYHSGLISRLSISKDDSKSQVFLKLNSLQTDDTATYYCAKPGSYPYYFDYWGQGTTLTVSSAKTTPPSVYPLA

SEQ ID NO: 15716 - protein, 126 aa, Artificial Sequence
  Description of Artificial Sequence: Synthetic polypeptide
  Amino acid sequence identified using molecular biology technique
QVQLQQSGPELAKPGASVKLSCKASGDTFTIYDINWVKQRPGQGLEWIGWIYPRDGSTKYNEKFKGKATLTVETSSSTAYMELHSLTSEDSAVYFCARGWFVYWGQGTLVTVSAAKTTPPSVYPLA

SEQ ID NO: 15717 - protein, 126 aa, Artificial Sequence
  Description of Artificial Sequence: Synthetic polypeptide
  Amino acid sequence identified using molecular biology technique
EVKLVESGPEVVKPGASVKLSCKASGFIFTIYDINWVKQRPGQGLEWIGWIYPRDGSTKYNEKFKGKATLTVDTSSSTAYMDLHSLTSEESAVYFCARGWFAYWGQGTLVTVSAAKTTAPSVYPLA

SEQ ID NO: 15718 - protein, 132 aa, Artificial Sequence
  Description of Artificial Sequence: Synthetic polypeptide
  Amino acid sequence identified using molecular biology technique
QVQLQQSGAELVRPGASVTLSCKASGYTFTDYEIHWVKQTPVHGLEWIGPIDPETGNTAYNQKFKGKAIMTVDKSSSTAYMELRSLTSEDSAVYYCTREGLRGHWYFDVWGAGTTVTVSSAKTTPPSDYPLV

SEQ ID NO: 15719 - protein, 118 aa, Artificial Sequence
  Description of Artificial Sequence: Synthetic polypeptide
  cImmu31Vh protein sequence
QVQLQESGPELVKPGASVKMSCKASGYAFTSYVIHWVRQKPGQGLYWIGYIHPYNGGTKYNEKFKGKATLTSDKSSSTTYMELSSLTSEDSAVYYCARSGGGDPFAYWGQGTTVTVSS

SEQ ID NO: 15720 - protein, 118 aa, Artificial Sequence
  Description of Artificial Sequence: Synthetic polypeptide
  hImmu31Vh protein sequence
QVQLQQSGAEVKKPGSSVKVSCKASGYAFTSYVIHWVRQAPGQGLYWIGYIHPYNGGTKYNEKFKGKATITADESTNTAYMELSSLRSEDTAFYFCARSGGGDPFAYWGQGSLVTVSS

SEQ ID NO: 15721 - protein, 117 aa, Artificial Sequence
  Description of Artificial Sequence: Synthetic polypeptide
  Immu31Vh protein sequence
VKLQESGPELVKPGASVKMSCKASGYAFTSYVIHWVRQKPGQGLYWIGYIHPYNGGTKYNEKFKGKATLTSDKSSSTTYMELSSLTSEDSAVYYCARSGGGDPFAYWGQGTLVTVSA

SEQ ID NO: 15722 - protein, 127 aa, Artificial Sequence
  Description of Artificial Sequence: Synthetic polypeptide
  heavy chain antigen binding region(heavy chain variable region) of anti-Ang2 antibody
EVQLLESGGGLVQTGGSLRLSCAASGFTFSDYAMSWVRQAPGKGLEWVSAIYPDSGNKYYADSVKGRFTISRDNSKNTLYLQMNSLRAEDTAVYYCARHSSDPKVKSGYYDDGMDVWGQGTLVAVSS

SEQ ID NO: 15723 - protein, 121 aa, Artificial Sequence
  Description of Artificial Sequence: Synthetic polypeptide
  heavy chain antigen binding region(heavy chain variable region) of anti-Ang2 antibody
EVQLLESGGGLVQPGGSLRLSCAASGFTFSDYYMSWVRQAPGKGLEWVSGIYPSGGSTYYADSVKGRFTISRDNSKNTLYLQMNSLRAEDTAVYYCARDPSTLTYAGFDYWGQGTLVTVSS

SEQ ID NO: 15724 - protein, 127 aa, Artificial Sequence
  Description of Artificial Sequence: Synthetic polypeptide
  heavy chain antigen binding region(heavy chain variable region) of anti-Ang2 antibody
EVQLLESGGGLVQPGGSLRLSCAASGFTFSNYAMSWVRQAPGKGLEWVSAISSGGGNIYYADSVKGRFTISRDNSKNTLYLQMNSLRAEDTAVYYCAKSGIQPSPPSMSSAYAMDVWGQGTLVTVSS

SEQ ID NO: 15725 - protein, 127 aa, Artificial Sequence
  Description of Artificial Sequence: Synthetic polypeptide
  heavy chain antigen binding region(heavy chain variable region) of anti-Ang2 antibody
EVQLLESGGGLVQPGGSLRLSCAASGFTFSDYAMSWVRQAPGKGLEWVSSIYPDDGNTYYADSVKGRFTISRDNSKNTLYLQMNSLRAEDTAVYYCARHTSHHTSIDGYYYYGMDGWGQGTLVTVSS

SEQ ID NO: 15726 - protein, 127 aa, Artificial Sequence
  Description of Artificial Sequence: Synthetic polypeptide
  heavy chain antigen binding region(heavy chain variable region) of anti-Ang2 antibody
EVQLLESGGGLVQPGGSLRLSCAASGFTFSDYDMSWVRQAPGKGLEWVSSISHGDSNKYYADSVKGRFTISRDNSKNTLYLQMNSLRAEDTAVYYCAKSSGIQESPPTYYYYGMDVWGQGTLVTVSS

SEQ ID NO: 15727 - protein, 127 aa, Artificial Sequence
  Description of Artificial Sequence: Synthetic polypeptide
  heavy chain antigen binding region(heavy chain variable region) of anti-Ang2 antibody
EVQLLESGGGLVQTGGSLRLSCAASGFTFSDYAMSWVRQAPGKGLEWVSSIYPDDGNTYYADSVKGRFTISRDNSKNTLYLQMNSLRAEDTAVYYCAKHPVRLNLHPMYYYYGMDVWGQGTLVTVSS

SEQ ID NO: 15728 - protein, 121 aa, Artificial Sequence
  Description of Artificial Sequence: Synthetic polypeptide
  heavy chain antigen binding region(heavy chain variable region) of anti-Ang2 antibody
EVQLLESGGGLVQPGGSLRLSCAASGFTFSSYDMSWVRQAPGKGLEWVSLISPDSSSIYYADSVKGRFTISRDNSKNTLYLQMNSLRAEDTAVYYCAKDLISFWRGGFDYWGQGTLVTVSS

SEQ ID NO: 15729 - protein, 127 aa, Artificial Sequence
  Description of Artificial Sequence: Synthetic polypeptide
  heavy chain antigen binding region(heavy chain variable region) of anti-Ang2 antibody
EVQLLESGGGLVQPGGSLRLSCAASGFTFSDYDMSWVRQAPGKGLEWVSGISSDDGNTYYADSVKGRFTISRDNSKNTLYLQMNSLRAEDTAVYYCARPTIDKYTLRGYYSYGMDVWGQGTLVTVSS

SEQ ID NO: 15730 - protein, 121 aa, Artificial Sequence
  Description of Artificial Sequence: Synthetic polypeptide
  heavy chain antigen binding region(heavy chain variable region) of anti-Ang2 antibody
QVQLQQSGAELMKPGASVKISCKATDYTFSSYWLEWLIQRPGHGLEWIGEILPGSGSTNYNEKFRGKATFTEDTSSNTAYMQLSSLTSEDSAVYYCARGNHNSYYYAMDYWGQGTSVTVSS

SEQ ID NO: 15731 - protein, 118 aa, Artificial Sequence
  Description of Artificial Sequence: Synthetic polypeptide
  heavy chain antigen binding region(heavy chain variable region) of anti-Ang2 antibody
EVQLQQSGAELVKPGASVKLSCTASGFNIKDPYIHWVKQRPEQGLEWIGRIDPANGNTKYDPKFQGKATITADTSSNTAYLQLSSLTSEDTAVYYCVRRWDGGGFDYWGQGTSVTVSS

SEQ ID NO: 15732 - protein, 120 aa, Artificial Sequence
  Description of Artificial Sequence: Synthetic polypeptide
  heavy chain antigen binding region(heavy chain variable region) of anti-Ang2 antibody
EVQLQQSGPELVKPGDSVKMSCKASGYTFTDYYMKWVRQSHGKSLQWVGEINPKNGDTFYNQIFKGKATLTVDKSSSTAYMQLTSLTSEDSAVYYCTRENDYDVGFFDYWGQGTSVTVSS

SEQ ID NO: 15733 - protein, 118 aa, Artificial Sequence
  Description of Artificial Sequence: Synthetic polypeptide
  heavy chain antigen binding region(heavy chain variable region) of anti-Ang2 antibody
QIQLVQSGPELKKPGETVKISCKASGYTFTNYGMNWVKQAPGKGLKWMGWINTYTGEPTYADDFKGRFAFSLETSASTAYLQINNLKNEDTATYFCARDHDGYLMDYWGQGTSVTVSS

SEQ ID NO: 15734 - protein, 148 aa, Artificial Sequence
  Description of Artificial Sequence: Synthetic polypeptide
MDWLRNLLFLMAAAQSIQAQVQLVQSGPELKKPGETVKISCKASDYTFTYYGMNWVKQAPGKGLKWMGWIDTTTGEPTYAEDFKGRIAFSLETSASTAYLQIKNLKNEDTATYFCARRGPYNWYFDVWGAGTTVTVSSAKTTPPSVYP

SEQ ID NO: 15735 - protein, 121 aa, Artificial Sequence [sequence omitted]

SEQ ID NO: 15736 - protein, 121 aa, Artificial Sequence
  Description of Artificial Sequence: Synthetic polypeptide
  Anti-CD19 single variable domain VH (clone 4G7)
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 15737 - protein, 121 aa, Artificial Sequence
  Description of Artificial Sequence: Synthetic polypeptide
  CD19 (8B8-018) VH; CD19 (8B8-5A07) VH; CD19 (8B8-5H09) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 15738 - protein, 121 aa, Artificial Sequence
  Description of Artificial Sequence: Synthetic polypeptide
  CD19 (8B8-2B03) VH
QVQLVQSGAEVKKPGASVKVSCKASGYTFTDYITHWVRQAPGQGLEWMGYINPYNDGSKYTEKFQGRVTMTSDTSISTAYMELSRLRSDDTAVYYCARGTYYYGPDLFDYWGQGTTVTVSS

SEQ ID NO: 15739 - protein, 121 aa, Artificial Sequence
  Description of Artificial Sequence: Synthetic polypeptide
  CD19 (8B8-2B11) VH; CD19 (8B8-5B08) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 15740 - protein, 121 aa, Artificial Sequence
  Description of Artificial Sequence: Synthetic polypeptide
  CD19 (8B8-7H07) VH; CD19 (8B8-5D08) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSELFDYWGQGTTVTVSS

SEQ ID NO: 15741 - protein, 124 aa, Artificial Sequence; identical to SEQ ID NO: 5450
  Description of Artificial Sequence: Synthetic polypeptide
  anti-CD19 antibody, cA19

SEQ ID NO: 15742 - protein, 124 aa, Artificial Sequence; identical to SEQ ID NO: 5448
  Description of Artificial Sequence: Synthetic polypeptide
  humanized hA19VH antibody

SEQ ID NO: 15743 - protein, 124 aa, Artificial Sequence; identical to SEQ ID NO: 13034
  Description of Artificial Sequence: Synthetic polypeptide
  Synthetic CD19 VH

SEQ ID NO: 15744 - protein, 122 aa, Artificial Sequence [sequence omitted]

SEQ ID NO: 15745 - protein, 122 aa, Artificial Sequence
  Description of Artificial Sequence: Synthetic polypeptide
  heavy chain variable
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSASYWYFDVWGQGTLVTVSS

SEQ ID NO: 15746 - protein, 122 aa, Artificial Sequence; identical to SEQ ID NO: 5580
  Description of Artificial Sequence: Synthetic polypeptide
  heavy chain variable

SEQ ID NO: 15747 - protein, 112 aa, Artificial Sequence
  Description of Artificial Sequence: Synthetic polypeptide
  CRIS7 VH
QVQLQQSGAELARPGASVKMSCKASGYTFTRSTMHWVKQRPGQGLEWIGYINPSSAYTNYNQKFKDKATLTADKSSSTAYMQLSSLTSEDSAVYYCASPQVHYDYNGFPYWG

SEQ ID NO: 15748 - protein, 121 aa, Artificial Sequence
  Description of Artificial Sequence: Synthetic polypeptide
  DRA161 VH
QVQLVQSGGGVVQPGRSLRLSCKASGYTFTRSTMHWVRQAPGKGLEWIGYINPSSAYTNYNQKFKDRFTISADKSKSTAFLQMDSLRPEDTGVYFCARPQVHYDYNGFPYWGQGTPVTVSS

SEQ ID NO: 15749 - protein, 120 aa, Artificial Sequence [sequence omitted]

SEQ ID NO: 15750 - protein, 119 aa, Artificial Sequence
  Description of Artificial Sequence: Synthetic polypeptide
  Chimeric Sequence (hOH)
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYSLDYWGQGTPVTVSS

SEQ ID NO: 15751 - protein, 119 aa, Artificial Sequence
  Description of Artificial Sequence: Synthetic polypeptide
  Synthetic CD3 VH
QVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSS

SEQ ID NO: 15752 - protein, 119 aa, Artificial Sequence; identical to SEQ ID NO: 5388
  Description of Artificial Sequence: Synthetic polypeptide
  Synthetic Construct

SEQ ID NO: 15753 - protein, 119 aa, Artificial Sequence; identical to SEQ ID NO: 5390
  Description of Artificial Sequence: Synthetic polypeptide
  Synthetic Construct

SEQ ID NO: 15754 - protein, 125 aa, Artificial Sequence
  Description of Artificial Sequence: Synthetic polypeptide
  VH humanized CD3 binder polypeptide
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSS

SEQ ID NO: 15755 - protein, 125 aa, Artificial Sequence
  Description of Artificial Sequence: Synthetic polypeptide
  VH CD3 clone VHcomboA49SV93A polypeptide
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCARHGNFGNSYVSWFAYWGQGTLVTVSS

SEQ ID NO: 15756 - protein, 125 aa, Artificial Sequence
  Description of Artificial Sequence: Synthetic polypeptide
  VH CD3 clone VHcomboA49SV93AR94K polypeptide
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCAKHGNFGNSYVSWFAYWGQGTLVTVSS

SEQ ID NO: 15757 - protein, 120 aa, Artificial Sequence; identical to SEQ ID NO: 6316
  Description of Artificial Sequence: Synthetic polypeptide

SEQ ID NO: 15758 - protein, 120 aa, Artificial Sequence; identical to SEQ ID NO: 6314
  Description of Artificial Sequence: Synthetic polypeptide

SEQ ID NO: 15759 - protein, 120 aa, Mus musculus; identical to SEQ ID NO: 6315

SEQ ID NO: 15760 - protein, 120 aa, Homo sapiens; identical to SEQ ID NO: 6317

SEQ ID NO: 15761 - protein, 121 aa, Artificial Sequence
  Description of Artificial Sequence: Synthetic polypeptide
  CH1A1A; VH
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSS

SEQ ID NO: 15762 - protein, 119 aa, Homo sapiens
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSS

SEQ ID NO: 15763 - protein, 119 aa, Mus sp.
EVKLLESGGGLVQSGGSLKLSCAASGFDFTTYWMSWVRQAPGKGLEWIGEIHPDSSTINYAPSLKDKFIVSRDNAKNTLYLQMSKVRSEDTALYYCASLYFGFPWFAYWGQGTPVTVSA

SEQ ID NO: 15764 - protein, 120 aa, Artificial Sequence
  Description of Artificial Sequence: Synthetic polypeptide
  CEA(sm9b) VH
QVKLEQSGAEVVKPGASVKLSCKASGFNIKDSYMHWLRQGPGQCLEWIGWIDPENGDTEYAPKFQGKATFTTDTSANTAYLGLSSLRPEDTAVYYCNEGTPTGPYYFDYWGQGTLVTVSS

SEQ ID NO: 15765 - protein, 140 aa, Artificial Sequence
  Description of Artificial Sequence: Synthetic polypeptide
  anti-mu CEA T84.66 VH
MKCSWVIFFLMAVVTGVNSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSS

SEQ ID NO: 15766 - protein, 242 aa, Artificial Sequence
  Description of Artificial Sequence: Synthetic polypeptide
  CEA(T84.66-LCHA) VH
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSQVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 15767 - protein, 121 aa, Artificial Sequence
  Description of Artificial Sequence: Synthetic polypeptide
  Parental CEA binder VH
EVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSS

SEQ ID NO: 15768 - protein, 127 aa, Artificial Sequence
  Description of Artificial Sequence: Synthetic polypeptide
  Heavy chain variable region of synthetic 1F12 scFv A/a sequence
EVQLLESGGGLVQPGGSLRLSCAASGFTFSNYAMSWVRQAPGKGLEWVSGISYSGGSTYYADSVKGRFTISRDNSKNTLYLQMNSLRAEDTAVYYCAKASRSCQRPACSYANGMDVWGQGTLVTVSS

SEQ ID NO: 15769 - protein, 118 aa, Mus musculus; identical to SEQ ID NO: 11169

SEQ ID NO: 15770 - protein, 118 aa, Mus musculus; identical to SEQ ID NO: 10437

SEQ ID NO: 15771 - protein, 121 aa, Artificial Sequence
  Description of Artificial Sequence: Synthetic polypeptide
  Heavy chain variable region of synthetic 2A01 scFv A/a sequence
EVQLLESGGGLVQTGGSLRLSCAASGFTFSSYDMSWVRRAPGKGLEWVSWISHGGSSISYADSVKGRFTISRDNSKNTLYLQMNSLRAEDTAVYYCAKDAYPIRQETFDYWGQGTLVTVSS

SEQ ID NO: 15772 - protein, 127 aa, Artificial Sequence
  Description of Artificial Sequence: Synthetic polypeptide
  Heavy chain variable region of synthetic 2C03 scFv A/a sequence
EVQLLESGGGLVQPGGSLRLSCAASGFTFSNYAMSWVRQAPGKGLEWVSAISYDSGSIYYADSVKGRFTISRDNSKNTLYLQMNSLRAEDTAVYYCAKAARSCRNWSCSYANGMDVWGQGTLVTVSS

SEQ ID NO: 15773 - protein, 117 aa, Artificial Sequence; identical to SEQ ID NO: 11112
  Description of Artificial Sequence: Synthetic polypeptide
  Synthetic (heavy chain variable region of monoclonal antibody AbF46)

SEQ ID NO: 15774 - protein, 117 aa, Artificial Sequence; identical to SEQ ID NO: 11121
  Description of Artificial Sequence: Synthetic polypeptide
  Synthetic (heavy chain variable region of anti-c-Met antibody (AbF46 or huAbF46-H1))

SEQ ID NO: 15775 - protein, 116 aa, Artificial Sequence
  Description of Artificial Sequence: Synthetic polypeptide
  light chain variable region of anti-c-Met  antibody sequence
KIQLVQSGPELKKPGETVKISCKASGYTFTDNSMHWVKQAPGKGLKWMGWVNTETGEPTYADDFKGRFAFSLETSASTAYLQINNLKNEDTATYFCARDGHYFAYWGQGTLVTVSA

SEQ ID NO: 15776 - protein, 112 aa, Artificial Sequence
  Description of Artificial Sequence: Synthetic polypeptide
  heavy chain variable region sequence of LMH-82
EVQLQQSGPELVKPGASVKMSCKASGYTFTDYYMKWVKQSHGKNLEWIGDINPNNGGTNYNQKFKGKATLTVDKSSSTAYMQLNSLTSEDSAVYYCARSGYWGQGTTLTVSS

SEQ ID NO: 15777 - protein, 123 aa, Artificial Sequence
  Description of Artificial Sequence: Synthetic polypeptide
  heavy chain variable region sequence of LMH-85
QVQLQQSGAELAKPGASVKMSCKASGYTFIIYWIHWIKQRPGQGLEWIGYINPSNDYTEYNQKFKDKATLTADKSSNTAFMQLSSLTSEDSAVYYCARDSYDYDDGAYAMDYWGQGTSVTVSS

SEQ ID NO: 15778 - protein, 114 aa, Artificial Sequence
  Description of Artificial Sequence: Synthetic polypeptide
  heavy chain variable region sequence of antibody LMH-87
QVQLQQSGPELVKSGASVKMSCKASGNTLKDDHVHWVKQRPGQGLEWIGWIYPGGGRTRYNEKFKGKTTLTADKPSSTVNMLLSSLTSEDSAIYFCTNLVFDVWGAGTTVTVSS

SEQ ID NO: 15779 - protein, 119 aa, Homo Sapiens; identical to SEQ ID NO: 11135

SEQ ID NO: 15780 - protein, 125 aa, Homo Sapiens; identical to SEQ ID NO: 11130

SEQ ID NO: 15781 - protein, 115 aa, Artificial Sequence
  Description of Artificial Sequence: Synthetic polypeptide
  synthetic constuct
EVQLQQSGPELVKPGASVRISCKASGYTFTSRYIHWMKQRPGQGLEWIGWIYPVTGDTYYNEKFKGKATLTSDKSSSTAYMQISSLTSDDSAVYFCARGGGMFYYWGQGTLVTVS

SEQ ID NO: 15782 - protein, 114 aa, Artificial Sequence; identical to SEQ ID NO: 11185
  Description of Artificial Sequence: Synthetic polypeptide
  synthetic constuct

SEQ ID NO: 15783 - protein, 119 aa, Artificial Sequence [sequence omitted]

SEQ ID NO: 15784 - protein, 140 aa, Artificial Sequence
  Description of Artificial Sequence: Synthetic polypeptide
  a heavy chain variable region
MGWSYIILFLVATAADVHSQVQLQEWGAGLLKPSETLSLTCAVSGGSLSGHYWSWVRLPPGKGLEWIGEISHSGNTNYNSSLKSRASISIDTSKNEYSLNLKSVTAVDTAVYYCARFYGDYPSSYGMDVWGQGTTVTVSS

SEQ ID NO: 15785 - protein, 141 aa, Artificial Sequence
  Description of Artificial Sequence: Synthetic polypeptide
  a heavy chain variable region with extra cysteine
MGWSYIILFLVATAADVHSQVQLQEWGAGLLKPSETLSLTCAVSGGSLSGHYWSWVRLPPGKGLEWIGEISHSGNTNYNSSLKSRASISIDTSKNEYSLNLKSVTAVDTAVYYCARFYGDYPSSYGMDVWGQGTTVTVSSC

SEQ ID NO: 15786 - protein, 119 aa, Artificial Sequence
  Description of Artificial Sequence: Synthetic polypeptide
  synthetic construct
EVQLQQSGTVLARPGASVKMSCKASGYSFTSYWMYWVKQRPGQGLEWIGGFHPGNSGTNYNQKFKGKAKLTAVTSASTAYMELSSLTNEDSAVYYCTRGYYYDGSFTYWGQGTLVTVSA

SEQ ID NO: 15787 - protein, 119 aa, Artificial Sequence
  Description of Artificial Sequence: Synthetic polypeptide
  synthetic construct
EVQLQQSGTVLARPGASVKMSCKASGYSFTSYWMYWVKQRPGQGLEWIGGFHPRNSGTNYNQKFKGKAKLTAVTSASTAYMELSSLTNEDSAVYYCTRGYYYDGSFTYWGQGTLVTVSA

SEQ ID NO: 15788 - protein, 117 aa, Artificial Sequence; identical to SEQ ID NO: 12029
  Description of Artificial Sequence: Synthetic polypeptide
  Synthetic (heavy chain variable region of AT-VH1)

SEQ ID NO: 15789 - protein, 117 aa, Artificial Sequence; identical to SEQ ID NO: 11998
  Description of Artificial Sequence: Synthetic polypeptide
  Synthetic (heavy chain variable region of AT-VH2)

SEQ ID NO: 15790 - protein, 117 aa, Artificial Sequence; identical to SEQ ID NO: 11192
  Description of Artificial Sequence: Synthetic polypeptide
  Synthetic (heavy chain variable region of AT-VH3)

SEQ ID NO: 15791 - protein, 117 aa, Artificial Sequence; identical to SEQ ID NO: 11193
  Description of Artificial Sequence: Synthetic polypeptide
  Synthetic (heavy chain variable region of AT-VH4)

SEQ ID NO: 15792 - protein, 117 aa, Artificial Sequence; identical to SEQ ID NO: 11194
  Description of Artificial Sequence: Synthetic polypeptide
  Synthetic (heavy chain variable region of AT-VH5)

SEQ ID NO: 15793 - protein, 138 aa, Artificial Sequence
  Description of Artificial Sequence: Synthetic polypeptide
  Heavy Chain Variable Domain of BR55-2 Murine IgG3
MNLGLSLIFLVLVLKGVQCEVKLVESGGGLVQPGGSLKLSCATSGFTFSDYYMYWVRQTPEKRLEWVAYISNGGGSSHYVDSVKGRFTISRDNAKNTLYLQMSRLRSEDTAMYHCARGMDYGAWFAYWGQGTLVTVSA

SEQ ID NO: 15794 - protein, 119 aa, Artificial Sequence
  Description of Artificial Sequence: Synthetic polypeptide
  humanized BR55-2, heavy chain
EVQLLESGGGLVQPGGSLRLSCAASGFTFSDYYMYWVRQAPGKGLEWVAYISNGGGSSHYVDSVKGRFTISRDNSKNTLYLQMNSLRAEDTALYYCARGMDYGAWFAYWGQGTLVTVSS

SEQ ID NO: 15795 - protein, 119 aa, Artificial Sequence
  Description of Artificial Sequence: Synthetic polypeptide
  humanized heavy chain variable region
EVQLLESGGGLVQPGGSLRLSCAASGFTFSDYYMYWVRQAPEKRLEWVAYISNGGGSSHYVDSVKGRFTISRDNSKNTLYLQMNSLRAEDTALYHCARGMDYGAWFAYWGQGTLVTVSS

SEQ ID NO: 15796 - protein, 117 aa, Artificial Sequence
  Description of Artificial Sequence: Synthetic polypeptide
  DR5(22E9) binder; variable heavy chain (VH)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGVRISFDYWGQGTLVTVSS

SEQ ID NO: 15797 - protein, 117 aa, Artificial Sequence
  Description of Artificial Sequence: Synthetic polypeptide
  DR5 (174-VH7) binder; variable heavy chain (VH)
EVQLVETGGGLIQPGGSLRLSCAASGFTVSRYAMIWVRQAPGKGLEYIGFITSDGSTYYADSAKGRFTISRDNSKNTLYLQMNSLRAEDTAVYYCARYTYSDGTDLWGRGTLVTVSS

SEQ ID NO: 15798 - protein, 117 aa, Artificial Sequence
  Description of Artificial Sequence: Synthetic polypeptide
  DR5 (18F11) binder_variable heavy chain (VH)
EVQLLESGGGLVQPGGSLRLSCAASGFTFSSYAMSWVRQAPGKGLEWVSAISGSGGSTYYADSVKGRFTISRDNSKNTLYLQMNSLRAEDAAVYYCAKGVRKKFDYWGQGTLVTVSS

SEQ ID NO: 15799 - protein, 117 aa, Artificial Sequence
  Description of Artificial Sequence: Synthetic polypeptide
  DR5(20F2) binder; variable heavy chain (VH)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGVRKGFDYWGQGTLVTVSS

SEQ ID NO: 15800 - protein, 117 aa, Artificial Sequence
  Description of Artificial Sequence: Synthetic polypeptide
  DR5(21H3)binder; variable heavy chain (VH)
EVQLLESGGGLVQPGGSLRLSCAASGFTFSSYAMSWVRQAPGKGLEWVSAISGSGGSTYYADSVKGRFTISRDNSKNTLYLQMNSLRAEDMAVYYCAKGARVSFDYWGQGTLVTVSS

SEQ ID NO: 15801 - protein, 117 aa, Artificial Sequence
  Description of Artificial Sequence: Synthetic polypeptide
  DR5(5E11)binder_variable heavy chain (VH)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGVRVSFDYWGQGTLVTVSS

SEQ ID NO: 15802 - protein, 117 aa, Artificial Sequence
  Description of Artificial Sequence: Synthetic polypeptide
  DR5 (TAA-0006) binder; variable heavy chain (VH)
QSLEESGGRLVTPGTPLTLTCTASGFSLSSNHMSWVRQAPGKGLEWIGYIYAGSGSAYYASWAKGRFTISRTSTTVDLKMTSLTTEDTATYFCAGDAGSSYWEFNLWGPGTLVTVSS

SEQ ID NO: 15803 - protein, 117 aa, Artificial Sequence
  Description of Artificial Sequence: Synthetic polypeptide
  DR5 (TAA-0010) binder, variable heavy chain (VH)
QSLEESGGRLVKPDETLTLTCTVSGFSLSSNAISWVRQAPGMGLEWIGIIGSSGYTYYASWAKGRFTVSKTSTTVDLEIASPTTEDTATYFCARGYSGASDYSFNLWGPGTLVTVSS

SEQ ID NO: 15804 - protein, 114 aa, Artificial Sequence
  Description of Artificial Sequence: Synthetic polypeptide
  DR5 (TAA-0011) binder; variable heavy chain (VH); and DR5 (TAA-0052) binder; variable heavy chain (VH)
QSVEESGGRLVTPGTPLTLTCTVSGFSISRYAMIWVRQAPGEGLEYIGFITSDSSAYYASWAKGRFTISKTSTTVDLKMTSPTTEDTATYFCARYTYSDGTDLWGPGTLVTVSS

SEQ ID NO: 15805 - protein, 117 aa, Artificial Sequence
  Description of Artificial Sequence: Synthetic polypeptide
  DR5 (TAA-0013) binder; variable heavy chain (VH)
QSLEESGGRLVTPGTPLTLTCTASGFTISSYHMSWVRQAPGKGLEWIGYIYAGSASTWYASWVKGRFTISKTSTTVDLKMTSLTTEDTATYFCARDAGSSYWEFNLWGPGTLVTVSS

SEQ ID NO: 15806 - protein, 119 aa, Artificial Sequence
  Description of Artificial Sequence: Synthetic polypeptide
  DR5 (TAA-0016) binder; variable heavy chain (VH)
QSLEESGGRLVKPDETLTLTCTVSGFSLNNYAMSWVRQAPGKGLEWIGMINKYGTKYYATWTKGRATISKTSTTLDLEITSPTTEDTATYFCARVRYAGDDYAEWLDVWGQGILVTVSS

SEQ ID NO: 15807 - protein, 117 aa, Artificial Sequence
  Description of Artificial Sequence: Synthetic polypeptide
  DR5 (TAA-0019) binder, variable heavy chain (VH)
QSVEESGGRLVTPGTPLTLTCTVSGFSLSNYAMSWVRQAPGKGLEWIGIISSSGTTYYASWAKGRFTISKTSTTVDLKVTSPTTEDTATYFCARETYYGYSYAAGLWGPGTLVTVSS

SEQ ID NO: 15808 - protein, 117 aa, Artificial Sequence
  Description of Artificial Sequence: Synthetic polypeptide
  DR5 (174-VH17) binder; variable heavy chain
QVQLVESGGGLVQPGGSLRLSCSASGFSISRYAMIWVRQAPGKGLEYVGFITSDSSAYYASWAKGRFTISRDNSKNTLYLQMNSLRAEDTAVYYCARYTYSDGTDLWGQGTLVTVSS

SEQ ID NO: 15809 - protein, 114 aa, Artificial Sequence
  Description of Artificial Sequence: Synthetic polypeptide
  DR5 (TAA-0005) binder variable heavy chain (VH)
QSLEESGGRLVTPGTPLTLTCTASGFSLSSAYMSWVRQAPGKGLEWIGYIYSGSGSTWYASWVKGRFTISKTSTTVDLKITSPTTEDTATYFCARGYSTMGDLWGPGTLVTVSS

SEQ ID NO: 15810 - protein, 118 aa, Artificial Sequence
  Description of Artificial Sequence: Synthetic polypeptide
  Chimeric Sequence (h5H)
QVQLVQSGAEVKKPGASVKVSCKASGYTFTSYWMHWVRQAPGQGLEWMGNIYPGSGGTNYAEKFKNRVTMTRDTSISTAYMELSRLRSDDTAVYYCARSGGPYFFDYWGQGTLVTVSS

SEQ ID NO: 15811 - protein, 124 aa, Mus musculus; identical to SEQ ID NO: 4955

SEQ ID NO: 15812 - protein, 120 aa, Mus musculus; identical to SEQ ID NO: 11956

SEQ ID NO: 15813 - protein, 120 aa, Mus musculus; identical to SEQ ID NO: 11957

SEQ ID NO: 15814 - protein, 120 aa, Homo sapiens; identical to SEQ ID NO: 11958

SEQ ID NO: 15815 - protein, 122 aa, Homo sapiens; identical to SEQ ID NO: 11959

SEQ ID NO: 15816 - protein, 122 aa, Homo sapiens; identical to SEQ ID NO: 11960

SEQ ID NO: 15817 - protein, 122 aa, Mus musculus; identical to SEQ ID NO: 11961

SEQ ID NO: 15818 - protein, 125 aa, Homo sapiens; identical to SEQ ID NO: 11962

SEQ ID NO: 15819 - protein, 117 aa, Homo sapiens; identical to SEQ ID NO: 11963

SEQ ID NO: 15820 - protein, 124 aa, Homo sapiens; identical to SEQ ID NO: 11964

SEQ ID NO: 15821 - protein, 117 aa, Artificial Sequence
  Description of Artificial Sequence: Synthetic polypeptide
  Synthetic Humanized 1277 VH polypeptide
  MOD_RES (44)..(44): Gly or Arg
  MOD_RES (49)..(49): Ser or Ala
  MOD_RES (83)..(83): Met or Val
  MOD_RES (104)..(104): Met or Ile
EVQLVESGGGLVQPGGSLRLSCAASGFAFSYSDMSWVRQAPGKXLEWVXYMSSAGDVTFYSDTVKGRFTISRDNAKNSLYLQXNSLRAEDTAVYYCVRHRDVAXDYWGQGTTVTVSS

SEQ ID NO: 15822 - protein, 118 aa, Artificial Sequence; identical to SEQ ID NO: 11965
  Description of Artificial Sequence: Synthetic polypeptide

SEQ ID NO: 15823 - protein, 119 aa, Homo sapiens; identical to SEQ ID NO: 11966

SEQ ID NO: 15824 - protein, 125 aa, Homo sapiens; identical to SEQ ID NO: 11967

SEQ ID NO: 15825 - protein, 121 aa, Homo sapiens; identical to SEQ ID NO: 11968

SEQ ID NO: 15826 - protein, 117 aa, Homo sapiens; identical to SEQ ID NO: 11969

SEQ ID NO: 15827 - protein, 119 aa, Homo sapiens; identical to SEQ ID NO: 11970

SEQ ID NO: 15828 - protein, 121 aa, Artificial Sequence
  Description of Artificial Sequence: Synthetic polypeptide
  Synthetic Humanized 1565 VH polypeptide
  MOD_RES (20)..(20): Val or Leu
  MOD_RES (38)..(38): Arg or Lys
  MOD_RES (40)..(40): Ala or Arg
  MOD_RES (48)..(48): Met or Ile
  MOD_RES (55)..(56): Any naturally occurring amino acid
  MOD_RES (68)..(68): Val or Ala
  MOD_RES (70)..(70): Met or Leu
  MOD_RES (72)..(72): Arg or Val
  MOD_RES (74)..(74): Thr or Lys
  MOD_RES (79)..(79): Val or Ala
QVQLVQSGAEVKKPGASVKXSCKASGYTFTSYWMQWVXQXPGQGLEWXGNINPSXXGTSFNEEFKSRXTXTXDXSTSTXYMELSSLRSEDTAVYYCARDGGLYDGYYFDFWGQGTLVTVSS

SEQ ID NO: 15829 - protein, 122 aa, Artificial Sequence; identical to SEQ ID NO: 12021
  Description of Artificial Sequence: Synthetic polypeptide

SEQ ID NO: 15830 - protein, 117 aa, Artificial Sequence
  Description of Artificial Sequence: Synthetic polypeptide
EVQLVESGGGLVQPGGSLRLSCAASGFAFSYSDMSWVRQAPGKRLEWVSYMSSAGDVTFYSDTVKGRFTISRDNAKNSLYLQVNSLRAEDTAVYYCVRHRDVAMDYWGQGTTVTVSS

SEQ ID NO: 15831 - protein, 121 aa, Artificial Sequence
  Description of Artificial Sequence: Synthetic polypeptide
QVQLVQSGAEVKKPGASVKLSCKASGYTFTSYWMQWVRQAPGQGLEWIGNINPSNGGTSFNEEFKSRATMTRDTSTSTVYMELSSLRSEDTAVYYCARDGGLYDGYYFDFWGQGTLVTVSS

SEQ ID NO: 15832 - protein, 121 aa, Artificial Sequence
  Description of Artificial Sequence: Synthetic polypeptide
QVQLVQSGAEVKKPGASVKLSCKASGYTFTSYWMQWVRQAPGQGLEWIGNINPSNLGTSFNEEFKSRATMTRDTSTSTVYMELSSLRSEDTAVYYCARDGGLYDGYYFDFWGQGTLVTVSS

SEQ ID NO: 15833 - protein, 117 aa, Artificial Sequence
  Description of Artificial Sequence: Synthetic polypeptide
EVQLVESGGGLVQPGGSLRLSCAASGFAFSYSDMSWVRQAPGKRLEWVSYMSSAGDVTFYSDTVKGRFTISRDNAKNSLYLQVNSLRAEDTAVYYCVRHRDVAIDYWGQGTTVTVSS

SEQ ID NO: 15834 - protein, 117 aa, Homo Sapiens
QVQLVESGGGVVQPGRSLRLSCTASGFTFSHYGMYWVRQAPGKGLEWVAVIWYDGSYEYNEDSVKGRFTISRDNSKNTLYLQMNSLRAEDTAVYYCARDRVGLFDYWGQGTLVTVSS

SEQ ID NO: 15835 - protein, 121 aa, Artificial Sequence
  Description of Artificial Sequence: Synthetic polypeptide
  Synthetic construct - Synthetic peptide
QVQLQEWGAGLLKPSETLSLTCAVYGGSFSDYYWSWIRQPPGKGLEWIGEISHSGSTGYNPSLKSRVAISVDTPKNQFSLKLNSVTAADTALYYCARLTTVVGGNWFDPWGQGTLVTVSSA

SEQ ID NO: 15836 - protein, 117 aa, Mus musculus
EVHLQQSGPELEKPGASVKISCKASGYSFTGYNMNVKQSNGKSLEWIGNIDPYYGDTDYDQKFKGTLTADKSSNTVYMQLQSLTSEDSAVYYCARGAHRDYYAMDYWGQGTSVTVSS

SEQ ID NO: 15837 - protein, 125 aa, Homo Sapiens [sequence omitted]

SEQ ID NO: 15838 - protein, 121 aa, Homo Sapiens; identical to SEQ ID NO: 11858

SEQ ID NO: 15839 - protein, 122 aa, Artificial Sequence
  Description of Artificial Sequence: Synthetic polypeptide
  huEGFR-8 VH
QVQLVQSGAEVVKPGASVKLSCTTSGFTIKDTYIHWVKKRPGQGLEWIGRIDPTNGNNKYDQKFQGKATITADTSSNTAYLQLSSLTSEDTAVYYCTREDGYRYDDWYFDVWGQGTLVTVSS

SEQ ID NO: 15840 - protein, 116 aa, Artificial Sequence
  Description of Artificial Sequence: Synthetic polypeptide
  huML66 VH
QVQLQESGPGLVKPSETLSLTCTVSGLSLASNSVSWIRQPPGKGLEWMGVIWNHGGTDYNPSIKSRLSISRDTSKSQVFLKMNSLTAADTAMYFCVRKGGIYFDYWGQGVLVTVSS

SEQ ID NO: 15841 - protein, 120 aa, Rattus sp.; identical to SEQ ID NO: 11235
  ICR62 VH

SEQ ID NO: 15842 - protein, 120 aa, Artificial Sequence; identical to SEQ ID NO: 10350
  Description of Artificial Sequence: Synthetic polypeptide
  Synthetic heavy chain variable region construct

SEQ ID NO: 15843 - protein, 120 aa, Artificial Sequence; identical to SEQ ID NO: 14572
  Description of Artificial Sequence: Synthetic polypeptide
  Synthetic heavy chain variable region construct

SEQ ID NO: 15844 - protein, 120 aa, Artificial Sequence; identical to SEQ ID NO: 14573
  Description of Artificial Sequence: Synthetic polypeptide
  Synthetic heavy chain variable region construct

SEQ ID NO: 15845 - protein, 120 aa, Artificial Sequence; identical to SEQ ID NO: 14577
  Description of Artificial Sequence: Synthetic polypeptide
  Synthetic heavy chain variable region construct

SEQ ID NO: 15846 - protein, 120 aa, Artificial Sequence; identical to SEQ ID NO: 14578
  Description of Artificial Sequence: Synthetic polypeptide
  Synthetic heavy chain variable region construct

SEQ ID NO: 15847 - protein, 120 aa, Artificial Sequence; identical to SEQ ID NO: 14579
  Description of Artificial Sequence: Synthetic polypeptide
  Synthetic heavy chain variable region construct

SEQ ID NO: 15848 - protein, 120 aa, Artificial Sequence; identical to SEQ ID NO: 14574
  Description of Artificial Sequence: Synthetic polypeptide
  Synthetic heavy chain variable region construct

SEQ ID NO: 15849 - protein, 120 aa, Artificial Sequence; identical to SEQ ID NO: 14580
  Description of Artificial Sequence: Synthetic polypeptide
  Synthetic heavy chain variable region construct

SEQ ID NO: 15850 - protein, 120 aa, Artificial Sequence; identical to SEQ ID NO: 14590
  Description of Artificial Sequence: Synthetic polypeptide
  Synthetic heavy chain variable region construct

SEQ ID NO: 15851 - protein, 120 aa, Artificial Sequence; identical to SEQ ID NO: 14581
  Description of Artificial Sequence: Synthetic polypeptide
  Synthetic heavy chain variable region construct

SEQ ID NO: 15852 - protein, 120 aa, Artificial Sequence; identical to SEQ ID NO: 14582
  Description of Artificial Sequence: Synthetic polypeptide
  Synthetic heavy chain variable region construct

SEQ ID NO: 15853 - protein, 120 aa, Artificial Sequence; identical to SEQ ID NO: 14583
  Description of Artificial Sequence: Synthetic polypeptide
  Synthetic heavy chain variable region construct

SEQ ID NO: 15854 - protein, 120 aa, Artificial Sequence; identical to SEQ ID NO: 14584
  Description of Artificial Sequence: Synthetic polypeptide
  Synthetic heavy chain variable region construct

SEQ ID NO: 15855 - protein, 120 aa, Artificial Sequence; identical to SEQ ID NO: 14585
  Description of Artificial Sequence: Synthetic polypeptide
  Synthetic heavy chain variable region construct

SEQ ID NO: 15856 - protein, 120 aa, Artificial Sequence; identical to SEQ ID NO: 14586
  Description of Artificial Sequence: Synthetic polypeptide
  Synthetic heavy chain variable region construct

SEQ ID NO: 15857 - protein, 120 aa, Artificial Sequence; identical to SEQ ID NO: 14587
  Description of Artificial Sequence: Synthetic polypeptide
  Synthetic heavy chain variable region construct

SEQ ID NO: 15858 - protein, 120 aa, Artificial Sequence; identical to SEQ ID NO: 14588
  Description of Artificial Sequence: Synthetic polypeptide
  Synthetic heavy chain variable region construct

SEQ ID NO: 15859 - protein, 120 aa, Artificial Sequence; identical to SEQ ID NO: 14575
  Description of Artificial Sequence: Synthetic polypeptide
  Synthetic heavy chain variable region construct

SEQ ID NO: 15860 - protein, 120 aa, Artificial Sequence; identical to SEQ ID NO: 14576
  Description of Artificial Sequence: Synthetic polypeptide
  Synthetic heavy chain variable region construct

SEQ ID NO: 15861 - protein, 125 aa, Artificial Sequence
  Description of Artificial Sequence: Synthetic polypeptide
  Synthetic construct - Synthetic peptide
QVQLQESGPGLVKPSETVSLTCSVSGDSLSHNYWSWIRQPPGKGLEWIGYIYPSGTSGTTKYNPSLKSRVTISSDTSKNQFSLRLTSVTAADTAIYYCAKEAITANAWPVSDYWGQGTLVTVSSA

SEQ ID NO: 15862 - protein, 116 aa, Mus musculus; identical to SEQ ID NO: 11233

SEQ ID NO: 15863 - protein, 116 aa, Mus musculus; identical to SEQ ID NO: 11234

SEQ ID NO: 15864 - protein, 122 aa, Artificial Sequence
  Description of Artificial Sequence: Synthetic polypeptide
  muEGFR-8 VH
EVQLQQSGAELVKPGASVKLSCTTSGFNIKDTYIHWVKKRPEQGLEWIGRIDPTNGNNKYDPKFQGKATITADTSSNTAYLQLSSLTSEDTAVYYCTREDGYRYDDWYFDVWGAGTTVTVSS

SEQ ID NO: 15865 - protein, 140 aa, Artificial Sequence; identical to SEQ ID NO: 12013
  Description of Artificial Sequence: Synthetic polypeptide

SEQ ID NO: 15866 - protein, 138 aa, Artificial Sequence; identical to SEQ ID NO: 12014
  Description of Artificial Sequence: Synthetic polypeptide

SEQ ID NO: 15867 - protein, 142 aa, Artificial Sequence; identical to SEQ ID NO: 12015
  Description of Artificial Sequence: Synthetic polypeptide

SEQ ID NO: 15868 - protein, 116 aa, Artificial Sequence
  Description of Artificial Sequence: Synthetic polypeptide
  ratML66 VH
QVQLKESGPGLVQPSQTLSLTCTVSGLSLASNSVSWIRQPPGKGLEWMGVIWNHGGTDYNSVIKSRLSISRDTSKSQVFLKMNSLQTEDTAMYFCVRKGGIYFDYWGQGVMVTVSS

SEQ ID NO: 15869 - protein, 135 aa, Artificial Sequence; identical to SEQ ID NO: 11230
  Description of Artificial Sequence: Synthetic polypeptide

SEQ ID NO: 15870 - protein, 120 aa, Artificial Sequence [sequence omitted]

SEQ ID NO: 15871 - protein, 134 aa, Mus musculus; identical to SEQ ID NO: 10474

SEQ ID NO: 15872 - protein, 116 aa, Mus musculus; identical to SEQ ID NO: 11232

SEQ ID NO: 15873 - protein, 123 aa, Artificial Sequence
  Description of Artificial Sequence: Synthetic polypeptide
  Synthetic construct - Synthetic peptide
QVQLVQSGPGLVKPSETLSLTCTVSGGSVSSGTYCWSWIRQPPGKGLEWIAYICNSGSTSYNPSLKSRGTISVDTSKNQFSLRLSSVTAADTAVYYCARLSLIMVYHIFDYWGQGTLVTVSSA

SEQ ID NO: 15874 - protein, 125 aa, Artificial Sequence
  Description of Artificial Sequence: Synthetic polypeptide
  Synthetic construct - Synthetic peptide
QVQLVESGAEVRKPGASVKVSCQASGYTFTDHYLHWLRQAPGQGLEWMGWINPNIIEARYVARKFRGSVNLTRDTAIQTVYIEMSRLTSDDTATYFCARALKEGGYSYGYYDHWGPGTLVTVSSA

SEQ ID NO: 15875 - protein, 153 aa, Mus musculus
MRVLILLWLFTAFPGFLSDVQLQESGPGLVKPSQSLSLTCTVTAYSVTSDYAWNWIRQFPGNKLEWMGYISYSGTTRYNPSLKSRISITRDTSKNQFFLQLNSMTAEDTATYYCSRQGRGFPYWGQGTLVTVSAAKTTPPSVYPLAPGSAAQT

SEQ ID NO: 15876 - protein, 109 aa, Homo sapiens
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFV

SEQ ID NO: 15877 - protein, 120 aa, Mus sp.
VKLQESGPELKKPGETVKISCKASGYTFTNYGMNWVKQAPGKGLKWMGWINTYTGEPTYTDDFKGRFAFSLETSATTAYLQINNLKSEDMATYFCARGGFGSSYWYFDVWGQGTTVTVSS

SEQ ID NO: 15878 - protein, 117 aa, Artificial Sequence
  Description of Artificial Sequence: Synthetic polypeptide
  anti-endoglin single variable domain heavy chain (clone Kro23) VH
EVQLQQSGADLVRSGAAVKLSCTASGFNIKDYYLHWVKQRPEQGLEWIGWIDPENGDTEYAPKFQDKATMTADSSSNTAYLQLNSLTSEDTGVYYCNTRYGTSSACWGQGTTLTVSS

SEQ ID NO: 15879 - protein, 120 aa, Artificial Sequence
  Description of Artificial Sequence: Synthetic polypeptide
  Synthetic 3-1 VH
EVQLLEQSGAELVKPGASVKISCKASGYAFTNYWLGWVKQRPGHGLEWIGDLFPGSGNTHYNERFRGKATLTADKSSSTAFMQLSSLTSEDSAVYFCARLRNWDEAMDYWGQGTTVTVSS

SEQ ID NO: 15880 - protein, 124 aa, Artificial Sequence
  Description of Artificial Sequence: Synthetic polypeptide
  Synthetic 4-7 VH
EVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 15881 - protein, 120 aa, Artificial Sequence
  Description of Artificial Sequence: Synthetic polypeptide
  Synthetic 5-10 VH
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 15882 - protein, 118 aa, Homo sapiens; identical to SEQ ID NO: 12227
  VH domain

SEQ ID NO: 15883 - protein, 120 aa, Artificial Sequence
  Description of Artificial Sequence: Synthetic polypeptide
QVQLQQPGAELVRPGTSVKLSCKASGYTFTSHWLHWVKQRPGQGLEWIGVLDPSDFYSNYNQNFKGKATLTVDTSSSTAYMQLSSLTSEDSAVYYCARGLLSGDYAMDYWGQGTSVTVSS

SEQ ID NO: 15884 - protein, 120 aa, Artificial Sequence
  Description of Artificial Sequence: Synthetic polypeptide
QVTLKESGPGILRPSQTLSLTCSFSGFSLSTFGLSVGWIRQPSGKGLEWLAHIWWDDDKYYNPALKSRLTISKDTSKNQVFLKIANVDTADTATYYCARIGADALPFDYWGQGTTLTVSS

SEQ ID NO: 15885 - protein, 117 aa, Artificial Sequence
  Description of Artificial Sequence: Synthetic polypeptide
QVQLQQSDAELVKPGASVKISCKVSGYTFTDHIIHWMKQRPEQGLEWIGYIYPRDGYIKYNEKFKGKATLTADKSSSTAYMQVNSLTSEDSAVYFCARGYYYAMDYWGQGTSVTVSS

SEQ ID NO: 15886 - protein, 115 aa, Artificial Sequence
  Description of Artificial Sequence: Synthetic polypeptide
QVQLLQPGAELVRPGTSVKLSCKTSGYTFSSYWMHWVKQRPGQGLEWIGMIDPSDVYTNYNPKFKGKATLTVDTSSSTAYMQLSSLTSEDSAVYYCARNYSGDYWGQGTTLTVSS

SEQ ID NO: 15887 - protein, 121 aa, Artificial Sequence
  Description of Artificial Sequence: Synthetic polypeptide
QIQLVQSGPELKKPGEAVKISCKSSGYTFTTYGMSWVKQAPGRALKWMGWINTYSGVPTYADDFKGRFAFSLESSASTAYLQINNLKNEDTATYFCARGRDGYQVAWFAYWGQGTLVTVSA

SEQ ID NO: 15888 - protein, 115 aa, Artificial Sequence
  Description of Artificial Sequence: Synthetic polypeptide
QVQLQQPGAELVRPGTSVKLSCKASGYTFTNYWMHWVKQRPGQGLEWIGMIDPSDSYTNYNPKFKGKATLTVDTSSSTAYMQLSSLTSEDSAVYYCARNYSGDYWGQGTTLTVSS

SEQ ID NO: 15889 - protein, 119 aa, Artificial Sequence
  Description of Artificial Sequence: Synthetic polypeptide
EVQLVESGGGLVKPGGSLKLSCAASGFTFSDYAMSWVRQTPEKRLEWVATISDGGTYTYYPDNVKGRFTISRDNAKNNLYLQMSHLKSEDTAMYYCAREWGDYDGFDYWGQGTTLTVSS

SEQ ID NO: 15890 - protein, 119 aa, Artificial Sequence
  Description of Artificial Sequence: Synthetic polypeptide
EVQLVESGGGLVKPGGSLRLSCAASGFTFSDYAMSWVRQAPGKGLEWVATISDGGTYTYYPDNVKGRFTISRDNAKNSLYLQMNSLRAEDTAVYYCAREWGDYDGFDYWGQGTLVTVSS

SEQ ID NO: 15891 - protein, 119 aa, Artificial Sequence [sequence omitted]

SEQ ID NO: 15892 - protein, 119 aa, Artificial Sequence
  Description of Artificial Sequence: Synthetic polypeptide
QVQLVESGGGLVKPGGSLRLSCAASGFTFSDYAMSWIRQAPGKGLEWVSTISDGGTYTYYPDNVKGRFTISRDNAKNSLYLQMNSLRAEDTAVYYCAREWGDYDGFDYWGQGTLVTVSS

SEQ ID NO: 15893 - protein, 119 aa, Artificial Sequence
  Description of Artificial Sequence: Synthetic polypeptide
QVQLVESGGGLVKPGGSLRLSCAASGFTFSDYAMSWIRQAPGKGLEWVSTISDGGTYTYYPDSVKGRFTISRDNAKNSLYLQMNSLRAEDTAVYYCAREWGDYDGFDYWGQGTLVTVSS

SEQ ID NO: 15894 - protein, 119 aa, Artificial Sequence
  Description of Artificial Sequence: Synthetic polypeptide
EVQLVESGGGLVKPGGSLRLSCAASGFTFSDYAMSWVRQAPGKGLEWVSTISDGGTYTYYPDNVKGRFTISRDNAKNSLYLQMNSLRAEDTAVYYCAREWGDYDGFDYWGQGTLVTVSS

SEQ ID NO: 15895 - protein, 119 aa, Artificial Sequence
  Description of Artificial Sequence: Synthetic polypeptide
EVQLLESGGGLVQPGGSLRLSCAASGFTFSDYAMSWVRQAPGKGLEWVSTISDGGTYTYYPDNVKGRFTISRDNSKNTLYLQMNSLRAEDTAVYYCAREWGDYDGFDYWGQGTLVTVSS

SEQ ID NO: 15896 - protein, 119 aa, Artificial Sequence
  Description of Artificial Sequence: Synthetic polypeptide
QVQLVESGGGVVQPGRSLRLSCAASGFTFSDYAMSWVRQAPGKGLEWVATISDGGTYTYYPDNVKGRFTISRDNSKNTLYLQMSSLRAEDTAVYYCAREWGDYDGFDYWGQGTLVTVSS

SEQ ID NO: 15897 - protein, 119 aa, Artificial Sequence
  Description of Artificial Sequence: Synthetic polypeptide
EVQLVESGGGLVQPGGSLRLSCAASGFTFSDYAMSWVRQAPGKGLEWVATISDGGTYTYYPDNVKGRFTISRDNAKNSLYLQMNSLRAEDTAVYYCAREWGDYDGFDYWGQGTLVTVSS

SEQ ID NO: 15898 - protein, 122 aa, Artificial Sequence
  Description of Artificial Sequence: Synthetic polypeptide
QVQLVESGGGVVQSGKSLRLSCVASGFTFSNYGMHWVRQTPGKGLEWVARIWFDGTNKYYTDSVKGRFTLSRDSSKNTLYLQMNSLRAEDTAVYFCAREESLELDHYVMDVWGQGTTVTVSS

SEQ ID NO: 15899 - protein, 119 aa, Artificial Sequence
  Description of Artificial Sequence: Synthetic polypeptide
EVQLVESGGGVVRPGGSLRLSCAASGFTFEDYGMNWVRQVPGKGLEWVSGTNWNGGITGYTGSVKGRFTISRDNAKNSLYLQMNSLRAEDTALYHCARDSGDQDAFDIWGQGTMVTVSS

SEQ ID NO: 15900 - protein, 123 aa, Artificial Sequence
  Description of Artificial Sequence: Synthetic polypeptide
EVQLVESGGGLVQPGGSLRLSCAASGFTFSSYDMHWVRQATGKGLEWVSAIGPAGDTYYPVSAMGRFTISRDDAKNSLYLQMNSLRAGDTAVYYCAREGVTIRPDDYFGLDVWGQGTTVTVSA

SEQ ID NO: 15901 - protein, 120 aa, Artificial Sequence
  Description of Artificial Sequence: Synthetic polypeptide
QVQLVESGGGVVQPGRSLRLSCAASGFTFSSFGMHWVRQAPGKGLEWVAVIWYVEINKYHADSVKGRFTISRDDSKNTVYLQMNSLRAEDTAVYYCARDWNDGDYGMDVWGQGTTVTVSS

SEQ ID NO: 15902 - protein, 123 aa, Artificial Sequence
  Description of Artificial Sequence: Synthetic polypeptide
EVQLVESGGGLVQPGGSLRLSCAASGFTFSNYDIHWVRQATGKGLEWVSAIGPAGDTYYSDSVKGRFTISREDAKNSLYLQMSSLRAGDTAVYYCASEGIAVRPDDYYGMDVWGQGTTVTVSA

SEQ ID NO: 15903 - protein, 127 aa, Artificial Sequence
  Description of Artificial Sequence: Synthetic polypeptide
EVQLLESGGDLVQPGGSLRLSCATSGFSFSSDAMNWVRQAPGKGLEWVSGISGSGGNTYYADSVKGRFTISRDISKSTLSLQMNSLRAEDTAVYYCAKEGTNMVRGVVMEDNGMDVWGQGTTVTVSA

SEQ ID NO: 15904 - protein, 119 aa, Artificial Sequence
  Description of Artificial Sequence: Synthetic polypeptide
QVQLVESGGGVVQPGRSLRLSCAASGFTFNNYGMHWVRQAPGKGLAWVAVMWYSESHKYYADSVKGRFTISRDNSKNTLYLEMNSLRVEDTAIYYCARDLGDPDAFDIWGQGTMVTVSS

SEQ ID NO: 15905 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAGMSYDGSSKYYEDSVKGRFTISRDNSKNTLNLQMNSLRVEDTAVYYCAKERDYVEYVDSYYGMDVWGQGTTVTVSA

SEQ ID NO: 15906 - protein, 125 aa, Artificial Sequence
  Description of Artificial Sequence: Synthetic polypeptide
EVQLVESGGGVVRPGGSLRLSCAASGFTFDDYGMSWVRQFPGKGLEWVSSIDGNGGNTGYSDSVKGRFTISRDNAKNSLHLQMNSLRAEDTALYHCARDPDYDSVWGNYRPFDYWGQGTLVTVSS

SEQ ID NO: 15907 - protein, 124 aa, Artificial Sequence
  Description of Artificial Sequence: Synthetic polypeptide
QVQLQESGPGLVKPSQTLSLTCTVSGGSINSGGYYWSWIRQHPGKGLEWIGYISYSGNTNYNPSLKSRVTISVDTSKNQFSLTLTSVTAADTAVYYCARDSDVDTGLVDGFDVWGQGTMVTVSS

SEQ ID NO: 15908 - protein, 124 aa, Artificial Sequence
  Description of Artificial Sequence: Synthetic polypeptide
EVQLVESGGGLVQPGGSLRLSCAASGFSVSYYDMHWVRQVTGKGLEWVSAIGPAGDTYYPGSVKGRFTISREDATNSLYLQIHSLGAGDTAVYYCAREGAIAARPDDYYGMDVWGQGTTVTVSS

SEQ ID NO: 15909 - protein, 121 aa, Artificial Sequence
  Description of Artificial Sequence: Synthetic polypeptide
EVQLVESGGGLVQPGRSLRLSCAASGFTFGDYAMHWVRQAPGKGLEWVSGINLNSGTIGYADSVKGRFTISRDNAKNSLYLQMNSLRAEDTAFYYCAKDIDGYYHYAMDVWGQGTTVTVSS

SEQ ID NO: 15910 - protein, 118 aa, Artificial Sequence
  Description of Artificial Sequence: Synthetic polypeptide
QVQLVESGGGVVQPGRSLRLSCAASGFTFINYGIHWVRQGPGKGLEWVAVIWYDGSNEWYADSVKGRFTISRDNSKNTVYLEMNKLRAEDTAVYYCAREEEDYGMDVWGQGTTVTVSS

SEQ ID NO: 15911 - protein, 119 aa, Artificial Sequence
  Description of Artificial Sequence: Synthetic polypeptide
QVQLVESGGGLVKPGGSLRLSCAASGFTFSDFNMGWIRQAPGKGLEWVSHISGSGNVIYYADSVKGRFAISRDNGKNSLYLQVNSLRAEDTAVYYCARDIGDSDAFDIWGQGTMVTVSS

SEQ ID NO: 15912 - protein, 119 aa, Artificial Sequence
  Description of Artificial Sequence: Synthetic polypeptide
EVQLVESGGGLVHPGRSLRLSCAASGFTFDDYAMHWVRQSPGKGLEWVSGISWNSVIKHSTDSVRGRFTISRDNAKNSLYLQMNSLKPEDTAFYYCAKDEDDWNYLDYWGQGTLVTVSS

SEQ ID NO: 15913 - protein, 122 aa, Artificial Sequence
  Description of Artificial Sequence: Synthetic polypeptide
QVQLVESGGGVVQPGRSLRLSCAASGFTFSNYGMHWVRQAPGKGLEWVARIWYDGSNKYYADSVKGRFTISRDSSKNTLYLQMNSLRAEDTAVYYCAREGEQNLDYYPLDVWGQGTTVTVSS

SEQ ID NO: 15914 - protein, 118 aa, Artificial Sequence
  Description of Artificial Sequence: Synthetic polypeptide
QVQLVQSGAEVKKPGASVKVSCKASGYTFTRYGISWVRQAPGLGLEWMGWISAYDGYTNFAQKFQGRFTMTTDTSTNTAYMELRGLRSDDTAVYYCAREEEDAAFDIWGQGTMVTVSS

SEQ ID NO: 15915 - protein, 124 aa, Artificial Sequence
  Description of Artificial Sequence: Synthetic polypeptide
QVQLQESGPGLINPSQTLSVTCTVSGGSISSGGYYWTWIRQHPGKGLEWIGYISYSGNTNYNPSLKSRVTISVDTAKNQFSLKLSSVTAADTAVYFCARDSDVDTAMVDGIDIWGQGTMVTVSS

SEQ ID NO: 15916 - protein, 123 aa, Artificial Sequence
  Description of Artificial Sequence: Synthetic polypeptide
EVQLLESGGGLVQPGGSLRLSCVASGFTFSSFAMSWVRQAPGKGLEWVSVISGSGGSTNHADSVRGRFTISRDNSLNTVYLQMHSLRAEDTALYYCVKAETSSSYFYYGMDVWGQGTTVTVSS

SEQ ID NO: 15917 - protein, 121 aa, Artificial Sequence
  Description of Artificial Sequence: Synthetic polypeptide
EVQLVESGGGVVRPGGSLRLSCAASGFTFDDYAMHWVRQAPGKGLEWVAGISWNSGSIDYADSVKGRFTISRDNAKNSLYLQMNSLRAGDTALYYCAKDILDLDYYGLDVWGQGTTVTVSS

SEQ ID NO: 15918 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSSISWNSGSIGYADSVKGRFTISRDNAKNSLYLQMNSLKPEDTALYYCTKDTDYGDYLDAFDIWGQGTMVAVAS

SEQ ID NO: 15919 - protein, 119 aa, Artificial Sequence
  Description of Artificial Sequence: Synthetic polypeptide
EVQLVESGGGVVRPGGSLRLSCAASGFTFDDYGMSWVRQAPGKGLECVSGINWNGGSTDYADSVKGRFTISRDNAKNSLYLQMNSLRAEDTASYYCARDGGDWDYFDLWGRGTLVTVSS

SEQ ID NO: 15920 - protein, 119 aa, Artificial Sequence
  Description of Artificial Sequence: Synthetic polypeptide
EVQLVESGGGVVRPGGSLRLSCAASGFTFDDYGMSWVRQAPGKGLECVSGISWNGGNTDYADSVKGRFTISRDNAKNSLYLQMNSLRAEDTALYHCARDGGDWDYFDLWGRGTLVTVSS

SEQ ID NO: 15921 - protein, 121 aa, Artificial Sequence
  Description of Artificial Sequence: Synthetic polypeptide
EVQLVESGGGLVQPGRSLRLSCAASGFTFDDYAMYWVRQAPGKGLEWVSGISWNSGSIGYADSVKGRFTISRDNAKNSLYLQMDSLRAEDTALYYCARDMMEVDLYGMDVWGQGTTVTVSS

SEQ ID NO: 15922 - protein, 119 aa, Artificial Sequence
  Description of Artificial Sequence: Synthetic polypeptide
EVQLVESGGGVVRPGGSLRLSCVASGFTFDDYGMSWVRQAPGKGLECVSGINWNGGSTDYADSVKGRFTISRDNAKNSLYLQMNSLRAEDTALYHCARDGGDWDYFDLWGRGTLVTVSS

SEQ ID NO: 15923 - protein, 119 aa, Artificial Sequence
  Description of Artificial Sequence: Synthetic polypeptide
EVQLVESGGGLVKPGGSLRLSCVASGFTFSSYNMNWVRQAPGKGLEWVSFISGSSNYIHYADSVKGRFTISRDNAKNALYLQMNSLRAEDTAVYYCARDDGDYDWFDPWGQGTLVTVSS

SEQ ID NO: 15924 - protein, 119 aa, Artificial Sequence
  Description of Artificial Sequence: Synthetic polypeptide
EVQLVQSGGGLVKPGGSLRLSCAASGFTFSNFNMNWVRQAPGKGLEWVSFISSLSTYTYYADSVKGRFTISRDNAKNSLYLQMNSLRAEDTAVYYCARDDGDHDWFDPWGQGTLVTVSS

SEQ ID NO: 15925 - protein, 121 aa, Artificial Sequence
  Description of Artificial Sequence: Synthetic polypeptide
EMQLVESGGGLVQPDRSLRLSCAASGFNFDNYAIHWVRQAPGKGLEWVSGISWNSGNIGYADSVKGRFTISRDNAKNSLFLLMNSLRPDDSALYYCTRGYNWNALSPMDVWGQGTTVTVSS

SEQ ID NO: 15926 - protein, 122 aa, Artificial Sequence
  Description of Artificial Sequence: Synthetic polypeptide
QVQLQQWDAGLLKPSETLSLTCAVYGGSFSSYYWSWIRQPPGKGLEWIGEINHRGSTNYNPSLKSRVTISVDTSKNQFSLKLRSVTAADTAVYYCARGGVAARPDWHFFDYWGQGTLVTVSS

SEQ ID NO: 15927 - protein, 119 aa, Artificial Sequence
  Description of Artificial Sequence: Synthetic polypeptide
EVQLVESGGGVVRPGGSLRLSCAASGFTFDDYGMSWVRQVPGKGLEWVSGLNWNGGITGYTDSVKGRFTISRDNAKNSLYLQMNSLRAEDTAFYHCARDSGDQDAFDIWGQGTMVTVSS

SEQ ID NO: 15928 - protein, 122 aa, Artificial Sequence
  Description of Artificial Sequence: Synthetic polypeptide
QVQVVESGGGVVQPGRSLRLSCAASGFTFSDYGMHWVRQAPGKGLEWVAIISYDGSNKYYADSVKGRFTVSRDNSKNTLYLQLDSLRPEDAAVFYCAREGAFNLDYYAMDVWGQGTTVTVSS

SEQ ID NO: 15929 - protein, 122 aa, Artificial Sequence
  Description of Artificial Sequence: Synthetic polypeptide
  Synthetic consensus sequence
  MOD_RES (1)..(1): Glu or Gln
  MOD_RES (6)..(6): Glu or Gln
  MOD_RES (16)..(16): Arg or Gly
  MOD_RES (49)..(49): Ser or Ala
  MOD_RES (54)..(54): Asp or Asn
  MOD_RES (58)..(58): Val, Arg, Thr, Ile, Met, Ser, Asn or Leu
  MOD_RES (88)..(88): Ala or Pro
  MOD_RES (93)..(93): Leu or Val
  MOD_RES (102)..(102): Ala, Phe or Tyr
  MOD_RES (103)..(103): Tyr, Asn, Lys, Phe, Met or Ser
  MOD_RES (106)..(106): Glu, Val, Trp, Leu, Gln or Asn
  MOD_RES (107)..(107): Glu or Asp
XVQLVXSGGGLVQPGXSLRLSCAASGFTFDDYAMHWVRQAPGKGLEWVXGISWXSGSXGYADSVKGRFTISRDNAKNSLYLQMNSLRXEDTAXYYCARDLGXXQWXXGFDYWGQGTLVTVSS

SEQ ID NO: 15930 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGAYQWEEGFDYWGQGTLVTVSS

SEQ ID NO: 15931 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSRGYADSVKGRFTISRDNAKNSLYLQMNSLRAEDTALYYCARDLGFNQWEEGFDYWGQGTLVTVSS

SEQ ID NO: 15932 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSS

SEQ ID NO: 15933 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSVGYADSVKGRFTISRDNAKNSLYLQMNSLRAEDTALYYCARDLGYNQWWEGFDYWGQGTLVTVSS

SEQ ID NO: 15934 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSS

SEQ ID NO: 15935 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSS

SEQ ID NO: 15936 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSS

SEQ ID NO: 15937 - protein, 122 aa, Artificial Sequence
  Description of Artificial Sequence: Synthetic polypeptide
QVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSS

SEQ ID NO: 15938 - protein, 122 aa, Artificial Sequence
  Description of Artificial Sequence: Synthetic polypeptide
QVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSS

SEQ ID NO: 15939 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCARDLGAKQWLEGFDYWGQGTLVTVSS

SEQ ID NO: 15940 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSMGYADSVKGRFTISRDNAKNSLYLQMNSLRAEDTALYYCARDLGAFQWEEGFDYWGQGTLVTVSS

SEQ ID NO: 15941 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSSGYADSVKGRFTISRDNAKNSLYLQMNSLRAEDTALYYCARDLGAFQWQEGFDYWGQGTLVTVSS

SEQ ID NO: 15942 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGAMQWVEGFDYWGQGTLVTVSS

SEQ ID NO: 15943 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCARDLGFNQWNEGFDYWGQGTLVTVSS

SEQ ID NO: 15944 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCARDLGFNQWLEGFDYWGQGTLVTVSS

SEQ ID NO: 15945 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSNGYADSVKGRFTISRDNAKNSLYLQMNSLRAEDTALYYCARDLGFMQWVDGFDYWGQGTLVTVSS

SEQ ID NO: 15946 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWVEGFDYWGQGTLVTVSS

SEQ ID NO: 15947 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLDGFDYWGQGTLVTVSS

SEQ ID NO: 15948 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSSGYADSVKGRFTISRDNAKNSLYLQMNSLRAEDTALYYCARDLGYNQWLEGFDYWGQGTLVTVSS

SEQ ID NO: 15949 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSMGYADSVKGRFTISRDNAKNSLYLQMNSLRAEDTALYYCARDLGYNQWLEGFDYWGQGTLVTVSS

SEQ ID NO: 15950 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSRGYADSVKGRFTISRDNAKNSLYLQMNSLRAEDTALYYCARDLGYNQWLEGFDYWGQGTLVTVSS

SEQ ID NO: 15951 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGYNQWQEGFDYWGQGTLVTVSS

SEQ ID NO: 15952 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSLGYADSVKGRFTISRDNAKNSLYLQMNSLRAEDTALYYCARDLGYSQWVEGFDYWGQGTLVTVSS

SEQ ID NO: 15953 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSSGYADSVKGRFTISRDNAKNSLYLQMNSLRAEDTALYYCARDLGFNQWVEGFDYWGQGTLVTVSS

SEQ ID NO: 15954 - protein, 117 aa, Artificial Sequence
  Description of Artificial Sequence: Synthetic polypeptide
  13C2; 13E8; 17A11; VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWLGPFDYWGQGTLVTVSS

SEQ ID NO: 15955 - protein, 117 aa, Artificial Sequence
  Description of Artificial Sequence: Synthetic polypeptide
  14B3; VH
EVQLLESGGGLVQPGGSLRLSCAASGFTFSSYAMSWVRQAPGKGLEWVSAILASGAITYYADSVKGRFTISRDNSKNTLYLQMNSLRAEDTAVYYCAKGWFGGFNYWGQGTLVTVSS

SEQ ID NO: 15956 - protein, 117 aa, Artificial Sequence
  Description of Artificial Sequence: Synthetic polypeptide
  14C10; VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKAWMGPFDYWGQGTLVTVSS

SEQ ID NO: 15957 - protein, 117 aa, Artificial Sequence
  Description of Artificial Sequence: Synthetic polypeptide
  16F1; VH
EVQLLESGGGLVQPGGSLRLSCAASGFTFSSYAMSWVRQAPGKGLEWVSGIIGSGGITYYADSVKGRFTISRDNSKNTLYLQMNSLRAEDTAVYYCAKGWFGGFNYWGQGTLVTVSS

SEQ ID NO: 15958 - protein, 117 aa, Artificial Sequence
  Description of Artificial Sequence: Synthetic polypeptide
  16F8; VH
EVQLLESGGGLVQPGGSLRLSCAASGFTFSSYAMSWVRQAPGKGLEWVSAILGSGGSTYYADSVKGRFTISRDNSKNTLYLQMNSLRAEDTAVYYCAKGWFGGFNYWGQGTLVTVSS

SEQ ID NO: 15959 - protein, 117 aa, Artificial Sequence
  Description of Artificial Sequence: Synthetic polypeptide
  19G1; VH
EVQLLESGGGLVQPGGSLRLSCAASGFTFSSYAMSWVRQAPGKGLEWVSAIISSGGLTYYADSVKGRFTISRDNSKNTLYLQMNSLRAEDTAVYYCAKGWFGGFNYWGQGTLVTVSS

SEQ ID NO: 15960 - protein, 117 aa, Artificial Sequence
  Description of Artificial Sequence: Synthetic polypeptide
  20G8; VH
EVQLLESGGGLVQPGGSLRLSCAASGFTFSSYAMSWVRQAPGKGLEWVSAIIGSGSRTYYADSVKGRFTISRDNSKNTLYLQMNSLRAEDTAVYYCAKGWFGGFNYWGQGTLVTVSS

SEQ ID NO: 15961 - protein, 117 aa, Artificial Sequence
  Description of Artificial Sequence: Synthetic polypeptide
  22A3; VH
EVQLLESGGGLVQPGGSLRLSCAASGFTFSSYAMSWVRQAPGKGLEWVSAIIGSGSITYYADSVKGRFTISRDNSKNTLYLQMNSLRAEDTAVYYCAKGWFGGFNYWGQGTLVTVSS

SEQ ID NO: 15962 - protein, 117 aa, Artificial Sequence
  Description of Artificial Sequence: Synthetic polypeptide
  23C10; VH
EVQLLESGGGLVQPGGSLRLSCAASGFTFSSSAMSWVRQAPGKGLEWVSAISTNGNYTYYADSVKGRFTISRDNSKNTLYLQMNSLRAEDTAVYYCAKGWLGNFDYWGQGTLVTVSS

SEQ ID NO: 15963 - protein, 116 aa, Artificial Sequence
  Description of Artificial Sequence: Synthetic polypeptide
  28H1; VH
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 15964 - protein, 117 aa, Artificial Sequence
  Description of Artificial Sequence: Synthetic polypeptide
  29B11; VH
EVQLLESGGGLVQPGGSLRLSCAASGFTFSSYAMSWVRQAPGKGLEWVSAIIGSGGITYYADSVKGRFTISRDNSKNTLYLQMNSLRAEDTAVYYCAKGWFGGFNYWGQGTLVTVSS

SEQ ID NO: 15965 - protein, 117 aa, Artificial Sequence
  Description of Artificial Sequence: Synthetic polypeptide
  2C4; 2D9; VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFTPFDYWGQGTLVTVSS

SEQ ID NO: 15966 - protein, 117 aa, Artificial Sequence
  Description of Artificial Sequence: Synthetic polypeptide
  2C6; VH
EVQLLESGGGLVQPGGSLRLSCAASGSTFSSYAMSWVRQAPGKGLEWVSAISGSAGYTYYADSVKGRFTISRDNSKNTLYLQMNSLRAEDTAVYYCAKGWFGNFDYWGQGTLVTVSS

SEQ ID NO: 15967 - protein, 117 aa, Artificial Sequence
  Description of Artificial Sequence: Synthetic polypeptide
  3D9, VH
EVQLLESGGGLVQPGGSLRLSCAASGFTFSSYAMSWVRQTPGKGLEWVSAIGVSTGSTYYADSVKGRFTISRDNSKNTLYLQMNSLRAEDTAVYYCAKGWLGPFDYWGQGTLVTVSS

SEQ ID NO: 15968 - protein, 117 aa, Artificial Sequence
  Description of Artificial Sequence: Synthetic polypeptide
  3D9(TA); VH
EVQLLESGGGLVQPGGSLRLSCAASGFTFSSYAMSWVRQAPGKGLEWVSAIGVSTGSTYYADSVKGRFTISRDNSKNTLYLQMNSLRAEDTAVYYCAKGWLGPFDYWGQGTLVTVSS

SEQ ID NO: 15969 - protein, 117 aa, Artificial Sequence
  Description of Artificial Sequence: Synthetic polypeptide
  3F2; O2D7; VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSS

SEQ ID NO: 15970 - protein, 117 aa, Artificial Sequence
  Description of Artificial Sequence: Synthetic polypeptide
  4B9; VH
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 15971 - protein, 117 aa, Artificial Sequence
  Description of Artificial Sequence: Synthetic polypeptide
  4G8; 4B3; 4D6; 4B8; VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWLGNFDYWGQGTLVTVSS

SEQ ID NO: 15972 - protein, 117 aa, Artificial Sequence
  Description of Artificial Sequence: Synthetic polypeptide
  5B8; VH
EVQLLESGGGLVQPGGSLRLSCAASGFTFSSYAMSWVRQAPGKGLEWVSAIWGGGRSTYYADSVKGRFTISRDNSKNTLYLQMNSLRAEDTAVYYCAKGWFGGFNYWGQGTLVTVSS

SEQ ID NO: 15973 - protein, 117 aa, Artificial Sequence
  Description of Artificial Sequence: Synthetic polypeptide
  5F1; VH
EVQLLESGGGLVQPGGSLRLSCAASGFTFSSYAMSWVRQAPGKGLEWVSAIISSGASTYYADSVKGRFTISRDNSKNTLYLQMNSLRAEDTAVYYCAKGWFGGFNYWGQGTLVTVSS

SEQ ID NO: 15974 - protein, 116 aa, Artificial Sequence
  Description of Artificial Sequence: Synthetic polypeptide
  5H5; VH
EVQLLESGGGLVQPGGSLRLSCAASGFTFSSYTMSWVRRSPGKGLEWVSAISGGGRTYYADSVKGRFTISRDNSKNTLYLQMNSLRAEDTAVYYCAKGWFTPFDYWGQGTLVTVSS

SEQ ID NO: 15975 - protein, 117 aa, Artificial Sequence
  Description of Artificial Sequence: Synthetic polypeptide
  7A1; VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGNFDYWGQGTLVTVSS

SEQ ID NO: 15976 - protein, 116 aa, Artificial Sequence
  Description of Artificial Sequence: Synthetic polypeptide
  VH of antibody F5 specific for fibroblast activation protein (FAP)
EVQLLESGGGLVQPGGSLRLSCAASGFTFSPAYMSWVRQAPGKGLEWVSAISGSGGSTYYADSVKGRFTISRDNSKNTLYLQMNSLRAEDTAVYYCAKGWRAFDYWGQGTLVTVSS

SEQ ID NO: 15977 - protein, 120 aa, Artificial Sequence
  Description of Artificial Sequence: Synthetic polypeptide
  Synthetic sequence: hu36-VH
QVQLVQSGAEVKKPGASVKVSCKASGYTFTENIIHWVRQAPGQGLEWMGWFHPGSGSIKYNEKFKDRVTMTADTSTSTVYMELSSLRSEDTAVYYCARHGGTGRGAMDYWGQGTLVTVSS

SEQ ID NO: 15978 - protein, 117 aa, Artificial Sequence
  Description of Artificial Sequence: Synthetic polypeptide
  O3C9; VH
EVQLLESGGGLVQPGGSLRLSCAASGFTFSSFAMSWVRQSPGKGLEWVSAIIGSGSNTYYADSVKGRFTISRDNSKNTLYLQMNSLRAEDTAVYYCAKGWFGGFNYWGQGTLVTVSS

SEQ ID NO: 15979 - protein, 129 aa, Homo sapiens
HVQLQESGPGLVKPSETLSLTCTVSGGSISSNNYYWGWIRQTPGKGLEWIGSIYYSGSTNYNPSLKSRVTISVDTSKNQFSLKLSSVTAADTAVYYCARGARWQARPATRIDGVAFDIWGQGTMVTVSS

SEQ ID NO: 15980 - protein, 129 aa, Homo sapiens
QVQLQESGPGLVKPSETLSLTCTVSGGSISSNNYYWGWIRQTPGKGLEWIGSIYYSGSTNYNPSLKSRVTISVDTSKNQFSLKLSSVTAADTAVYYCARGARWQARPATRIDGVAFDIWGQGTMVTVSS

SEQ ID NO: 15981 - protein, 121 aa, Homo sapiens
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDWSRSGYYLPDYWGQGTLVTVSS

SEQ ID NO: 15982 - protein, 143 aa, Homo sapiens
MGWSWVFLFLLSGTAGVLSEVQLQQSGPELVKPGASVKMSCKTSRYTFTEYTIHWVRQSHGKSLEWIGGINPNNGIPNYNQKFKGRATLTVGKSSSTAYMELRSLTSEDSAVYFCARRRIAYGYDEGHAMDYWGQGTSVTVSS

SEQ ID NO: 15983 - protein, 124 aa, Homo sapiens; identical to SEQ ID NO: 5374

SEQ ID NO: 15984 - protein, 124 aa, Homo sapiens; identical to SEQ ID NO: 5370

SEQ ID NO: 15985 - protein, 124 aa, Homo sapiens; identical to SEQ ID NO: 5371

SEQ ID NO: 15986 - protein, 124 aa, Homo sapiens; identical to SEQ ID NO: 5372

SEQ ID NO: 15987 - protein, 124 aa, Homo sapiens; identical to SEQ ID NO: 5373

SEQ ID NO: 15988 - protein, 127 aa, Homo sapiens
QVQLVESGGTLVQPGGSLRLSCAASGFTFSSYAMSWIRQAPGKGLEWVSGISASGGYIDYADSVKGRVTISRDNSKNMAYLQMSSLRAEDTALYYCAKGGNYQMLLDHWGQGTLVTVSSASTKGPKL

SEQ ID NO: 15989 - protein, 125 aa, Homo sapiens
QVQLVQSGAEVKKDGASVKVSCKATGGTFSGHAISWVRQAPGQRLEWMGEISPMFGTPNYAQSFQGRVTITADESTSYMEVSSLRSEDTATYYCARGANYRALLDYWGQGTLVTVSSASTKGPKL

SEQ ID NO: 15990 - protein, 134 aa, Homo sapiens
QVQLVESGGGLVQPGGSLRLSCAASGFTFSNYWMSWVRQAPGKGLEWVANIKQDGSEKYYVDSVKGRFTISRDNAKNSLYLQMNSLRAEDTAVYYCARGSLCTDGSCPTIGPGPNWGQGTLVTVSSAPTKAPKL

SEQ ID NO: 15991 - protein, 132 aa, Artificial Sequence
  Description of Artificial Sequence: Synthetic polypeptide
  Humanised Antibody
QVQLQQSGAEVKKPGSSVKVSCKASGGTFSTHTINWVRQAPGQGLEWMGGIAPMFGTANYAQKFQGRVTITADKSTSTAYMEMSSLRSDDTAVYYCARRRIAYGYDEGHAMDYWGQGTLVTVSSASTKGPKL

SEQ ID NO: 15992 - protein, 132 aa, Artificial Sequence
  Description of Artificial Sequence: Synthetic polypeptide
  Humanised Antibody
QVQLVQSGAELKKPGSSMKVSCKASGDTFSTYSINWVRQAPGQGLEWMGVINPSGGSTSYAQKFQGRVTMTRDTSTSTVYMELSSLRSEDTAVYYCARRRIAYGYDEGHAMDYWGQGTLVTVSSASTKGPKL

SEQ ID NO: 15993 - protein, 149 aa, Mus musculus
MGWSGVFIFILSGTAGVQSQVQLQQSGAELARPGASVNLSCKASGYTFTNNGINWLKQRTGQGLEWIGEIYPRSTNTLYNEKFKGKATLTADRSSNTAYMELRSLTSEDSAVYFCARTLTAPFAFWGQGTLVTVSAAKTTAPSVYPLAP

SEQ ID NO: 15994 - protein, 117 aa, Artificial Sequence
  Description of Artificial Sequence: Synthetic polypeptide
  Humanized mouse sequence
QVQLVQSGAEVKKPGASVKVSCKASGYTFTNNGINWLRQAPGQGLEWMGEIYPRSTNTLYAQKFQGRVTITADRSSNTAYMELSSLRSEDTAVYFCARTLTAPFAFWGQGTLVTVSS

SEQ ID NO: 15995 - protein, 118 aa, Artificial Sequence
  Description of Artificial Sequence: Synthetic polypeptide
  Synthetic sequence: B2 VH domain
EVQLVESGGGLVQPGGSLRLSCAASGFTFSAAKMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 15996 - protein, 118 aa, Artificial Sequence
  Description of Artificial Sequence: Synthetic polypeptide
  Synthetic sequence: B7 VH domain
EVQLVESGGGLVQPGGSLRLSCAASGFTFSHFDMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 15997 - protein, 118 aa, Artificial Sequence
  Description of Artificial Sequence: Synthetic polypeptide
  Synthetic sequence: C5 VH domain
EVQLVESGGGLVQPGGSLRLSCAASGFTFSPITMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 15998 - protein, 118 aa, Artificial Sequence
  Description of Artificial Sequence: Synthetic polypeptide
  Synthetic sequence: C8 VH domain
EVQLVESGGGLVQPGGSLRLSCAASGFTFSLQTMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 15999 - protein, 118 aa, Artificial Sequence
  Description of Artificial Sequence: Synthetic polypeptide
  Synthetic sequence: D5 VH domain
EVQLVESGGGLVQPGGSLRLSCAASGFTFSVMKMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16000 - protein, 118 aa, Artificial Sequence
  Description of Artificial Sequence: Synthetic polypeptide
  Synthetic sequence: E5 VH domain
EVQLVESGGGLVQPGGSLRLSCAASGFTFSTGSMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16001 - protein, 118 aa, Artificial Sequence
  Description of Artificial Sequence: Synthetic polypeptide
  Synthetic sequence: E8 VH domain
EVQLVESGGGLVQPGGSLRLSCAASGFTFSDMHMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16002 - protein, 118 aa, Artificial Sequence
  Description of Artificial Sequence: Synthetic polypeptide
  Synthetic sequence: F1 VH domain
EVQLVESGGGLVQPGGSLRLSCAASGFTFSQARMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16003 - protein, 118 aa, Artificial Sequence
  Description of Artificial Sequence: Synthetic polypeptide
  Synthetic sequence: F8 VH domain
EVQLVESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16004 - protein, 118 aa, Artificial Sequence
  Description of Artificial Sequence: Synthetic polypeptide
  Synthetic sequence: F8 VH V5L domain
EVQLLESGGGLVQPGGSLRLSCAASGFTFSLFTMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16005 - protein, 118 aa, Artificial Sequence
  Description of Artificial Sequence: Synthetic polypeptide
  Synthetic sequence: G9 VH domain
EVQLVESGGGLVQPGGSLRLSCAASGFTFSHMQMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16006 - protein, 118 aa, Artificial Sequence
  Description of Artificial Sequence: Synthetic polypeptide
  Synthetic sequence: H1 VH domain
EVQLVESGGGLVQPGGSLRLSCAASGFTFSPRRMSWVRQAPGKGLEWVSAISGSGGSTYYADSVKGRFTISRDNSKNTLYLQMNSLRAEDTAVYYCAKSTHLYLFDYWGQGTLVTVSS

SEQ ID NO: 16007 - protein, 116 aa, Artificial Sequence
  Description of Artificial Sequence: Synthetic polypeptide
  Synthetic amino acid sequence of antibody SW01 - VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNRYIFDYWGQGTLVTVSS

SEQ ID NO: 16008 - protein, 116 aa, Artificial Sequence
  Description of Artificial Sequence: Synthetic polypeptide
  Synthetic amino acid sequence of antibody SW02 - VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRFLFDYWGQGTLVTVSS

SEQ ID NO: 16009 - protein, 118 aa, Artificial Sequence
  Description of Artificial Sequence: Synthetic polypeptide
  anti-FLT3 chimeric single variable domain heavy chain (clone 4G8)VH
QVQLQQPGAELVKPGASLKLSCKSSGYTFTSYWMHWVRQRPGHGLEWIGEIDPSDSYKDYNQKFKDKATLTVDRSSNTAYMHLSSLTSDDSAVYYCARAITTTPFDFWGQGTTLTVSS

SEQ ID NO: 16010 - protein, 123 aa, Artificial Sequence
  Description of Artificial Sequence: Synthetic polypeptide
  anti-FLT3 single variable domain VH (clone BV10)
QVQLKQSGPGLVQPSQSLSITCTVSGFSLTNYGLHWVRQSPGKGLEWLGVIWSGGSTDYNAAFISRLSISKDNSKSQVFFKMNSLQADDTAIYYCARKGGIYYANHYYAMDYWGQGTSVTVSS

SEQ ID NO: 16011 - protein, 144 aa, Homo sapiens
MEFGLTWLFLVANLKGVQCEVQLLDSGGGLVQPGGCLRLSCAASGFTFSSCAMSWVRQAPGKGLEWVSAISGSGGSTYYADSVKGRFTISRDKSKNTLYLQMNSLRAEDTAVYYCAKGGNDILTGYYAWGQGTLVTVSSGSASA

SEQ ID NO: 16012 - protein, 113 aa, Artificial Sequence; identical to SEQ ID NO: 4981
  Description of Artificial Sequence: Synthetic polypeptide
  Humanized Immunoglobulin Heavy Chain Variable Region

SEQ ID NO: 16013 - protein, 118 aa, Artificial Sequence
  Description of Artificial Sequence: Synthetic polypeptide
  Murine KM666 VH (heavy chain variable region) sequence
QVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSA

SEQ ID NO: 16014 - protein, 105 aa, Homo sapiens
EVQLVESGGGLVQPGGSLRLSCAASGFTVSGSYMSWVRQAPGKGLEWVSVIYSGGSTYYADSVKGRFTISRDNSKNTLYLQMNSLRAEDTAVYYCARDLRGSYDY

SEQ ID NO: 16015 - protein, 119 aa, Artificial Sequence
  Description of Artificial Sequence: Synthetic polypeptide
EVQLVESGGDFVQPGGSLRVSCAASGFAFSHYAMSWVRQAPGKGLEWVAYISSGGSGTYYSDSVKGRFTISRDNSKNTLYLQMRSLRAEDSAVYFCTRVKLGTYYFDSWGQGTLLTVSS

SEQ ID NO: 16016 - protein, 138 aa, Mus musculus
MEFGLSWLFLVLVFKGVQCEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSS

SEQ ID NO: 16017 - protein, 112 aa, Mus sp.
  MB3.6 Light chain V region, plus leader
ASRGDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKR

SEQ ID NO: 16018 - protein, 130 aa, Artificial Sequence
  Description of Artificial Sequence: Synthetic polypeptide
  heavy chain variable region
LVLVFKGVQCEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSA

SEQ ID NO: 16019 - protein, 119 aa, Mus musculus
EVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSS

SEQ ID NO: 16020 - protein, 122 aa, Artificial Sequence
  Description of Artificial Sequence: Synthetic polypeptide
QVQLQESGPGLVKPSETLSLTCTVSGGSISTYYWSWFRQPPGKGLEWIGYIYYSGSTNHNPSLKSRVTISVDTSKNQFSLKLRSVTAADTAVYYCARVGPVGWGSWGNFDYWGQGTLVTVSS

SEQ ID NO: 16021 - protein, 132 aa, Artificial Sequence
  Description of Artificial Sequence: Synthetic polypeptide
  chimeic human antibody
MAVLVLLLCLVTFPSCVLSQVQLKESGPGLVQPSQTLSLTCTVSGFSLTSYTVSWVRQPPGKGLEWIAAISSGGSTYYNSALKSRLSISRDTSKSQVFLKMNSLQTEDTAMYFCAPSEGAWGQGVMVTVSSE

SEQ ID NO: 16022 - protein, 139 aa, Artificial Sequence
  Description of Artificial Sequence: Synthetic polypeptide
  chimeic human antibody
MGWSWIFLFLLSGTAGVLSEVQLQQSGPELVKPGASVKISCKASGYTFTDYNMDWVKQSHGKSLEWIGYIYPNNGGTGYNQKFKSKATLTVDKSSSTAYMELHSLTSEDSAVYYCATYGHYYGYMFAYWGQGTLVTVSA

SEQ ID NO: 16023 - protein, 124 aa, Artificial Sequence
  Description of Artificial Sequence: Synthetic polypeptide
  chimeic human antibody
VQLVQSGAEVKKPGASVKVSCKASGYTFTDYNMDWVKQSPGQGLEWMGYIYPNNGGTGYNQKFKSKVTITVDTSTSTAYMELHSLRSEDTAVYYCATYGHYYGYMFAYWGQGTLVTVSSASTKG

SEQ ID NO: 16024 - protein, 120 aa, Mus musculus; identical to SEQ ID NO: 12094

SEQ ID NO: 16025 - protein, 125 aa, Mus musculus; identical to SEQ ID NO: 12095

SEQ ID NO: 16026 - protein, 125 aa, Mus musculus; identical to SEQ ID NO: 12096

SEQ ID NO: 16027 - protein, 125 aa, Artificial Sequence; identical to SEQ ID NO: 12097
  Description of Artificial Sequence: Synthetic polypeptide

SEQ ID NO: 16028 - protein, 125 aa, Artificial Sequence; identical to SEQ ID NO: 12098
  Description of Artificial Sequence: Synthetic polypeptide

SEQ ID NO: 16029 - protein, 125 aa, Artificial Sequence; identical to SEQ ID NO: 12099
  Description of Artificial Sequence: Synthetic polypeptide

SEQ ID NO: 16030 - protein, 125 aa, Artificial Sequence; identical to SEQ ID NO: 12100
  Description of Artificial Sequence: Synthetic polypeptide

SEQ ID NO: 16031 - protein, 125 aa, Artificial Sequence; identical to SEQ ID NO: 12101
  Description of Artificial Sequence: Synthetic polypeptide

SEQ ID NO: 16032 - protein, 120 aa, Artificial Sequence
  Description of Artificial Sequence: Synthetic polypeptide
  Artificial antibody domain sequence
EVQLLESGGGLVQPGGSLRLSCAASGFRISDEDMGWVRQAPGKGLEWVSSIYGPSGSTYYADSVKGRFTISRDNSKNTLYLQMNSLRAEDTAVYYCASALEPLSEPLGFWGQGTLVTVSS

SEQ ID NO: 16033 - protein, 122 aa, Artificial Sequence; identical to SEQ ID NO: 12163
  Description of Artificial Sequence: Synthetic polypeptide

SEQ ID NO: 16034 - protein, 120 aa, Artificial Sequence; identical to SEQ ID NO: 12179
  Description of Artificial Sequence: Synthetic polypeptide

SEQ ID NO: 16035 - protein, 121 aa, Artificial Sequence; identical to SEQ ID NO: 12183
  Description of Artificial Sequence: Synthetic polypeptide

SEQ ID NO: 16036 - protein, 121 aa, Artificial Sequence; identical to SEQ ID NO: 12176
  Description of Artificial Sequence: Synthetic polypeptide

SEQ ID NO: 16037 - protein, 117 aa, Mus musculus; identical to SEQ ID NO: 12218

SEQ ID NO: 16038 - protein, 119 aa, Artificial Sequence
  Description of Artificial Sequence: Synthetic polypeptide
  Synthetic Humanized 4384 VH polypeptide
  MOD_RES (38)..(38): Arg or Lys
  MOD_RES (48)..(48): Met or Ile
  MOD_RES (55)..(55): Asn or Ser
  MOD_RES (68)..(68): Val or Ala
  MOD_RES (70)..(70): Met or Leu
  MOD_RES (72)..(72): Arg or Val
  MOD_RES (74)..(74): Thr or Lys
  MOD_RES (79)..(79): Val or Ala
QVQLVQSGAEVKKPGASVKVSCKASGYTFTSHWMHWVXQAPGQGLEWXGNINPSXGGTNYNEKFKSRXTXTXDXSTSTXYMELSSLRSEDTAVYYCARAYYDFSWFVYWGQGTLVTVSS

SEQ ID NO: 16039 - protein, 118 aa, Artificial Sequence; identical to SEQ ID NO: 12027
  Description of Artificial Sequence: Synthetic polypeptide

SEQ ID NO: 16040 - protein, 116 aa, Mus musculus; identical to SEQ ID NO: 12022

SEQ ID NO: 16041 - protein, 121 aa, Artificial Sequence
  Description of Artificial Sequence: Synthetic polypeptide
  Synthetic Humanized 4517 VH polypeptide
  MOD_RES (39)..(39): Gln or Leu
  MOD_RES (40)..(40): Ala or Thr
  MOD_RES (44)..(44): Gly or Arg
  MOD_RES (49)..(49): Ala or Ser
  MOD_RES (74)..(74): Asn or Ile
  MOD_RES (77)..(77): Asn or Ser
EVQLVESGGGLVKPGGSLRLSCAASGFTFSSYGMSWVRXXPGKXLEWVXTISGGGSYTYYPDSVKGRFTISRDXAKXSLYLQMNSLRAEDTAVYYCARKGNYGNYGKLAYWGQGTTVTVSS

SEQ ID NO: 16042 - protein, 120 aa, Artificial Sequence; identical to SEQ ID NO: 12216
  Description of Artificial Sequence: Synthetic polypeptide

SEQ ID NO: 16043 - protein, 115 aa, Mus musculus; identical to SEQ ID NO: 12160

SEQ ID NO: 16044 - protein, 119 aa, Artificial Sequence
  Description of Artificial Sequence: Synthetic polypeptide
QVQLVQSGAEVKKPGASVKVSCKASGYTFTSHWMHWVRQAPGQGLEWMGNINPSSGGTNYNEKFKSRVTLTVDKSTSTAYMELSSLRSEDTAVYYCARAYYDFSWFVYWGQGTLVTVSS

SEQ ID NO: 16045 - protein, 121 aa, Artificial Sequence
  Description of Artificial Sequence: Synthetic polypeptide
EVQLVESGGGLVKPGGSLRLSCAASGFTFSSYGMSWVRQAPGKGLEWVATISGGGSYTYYPDSVKGRFTISRDIAKSSLYLQMNSLRAEDTAVYYCARKGNYGNYGKLAYWGQGTTVTVSS

SEQ ID NO: 16046 - protein, 119 aa, Artificial Sequence
  Description of Artificial Sequence: Synthetic polypeptide
QVQLVQSGAEVKKPGASVKVSCKASGYTFTSHWMHWVRQAPGQGLEWMGNINPSSGGTNYNEKFKSRVTMTVDTSTSTVYMELSSLRSEDTAVYYCARAYYDFSWFVYWGQGTLVTVSS

SEQ ID NO: 16047 - protein, 119 aa, Artificial Sequence [sequence omitted]

SEQ ID NO: 16048 - protein, 120 aa, Artificial Sequence [sequence omitted]

SEQ ID NO: 16049 - protein, 123 aa, Artificial Sequence [sequence omitted]

SEQ ID NO: 16050 - protein, 119 aa, Artificial Sequence
  Description of Artificial Sequence: Synthetic polypeptide
EVQLVESGGGLVKPGGSLRLSCAASGFTFSSYGMFWVRQAPGKGLEWVATISRYSRYIYYPDSVKGRFTISRDNAKNSLYLQMNSLRAEDTAVYYCARRPLYGSSPDYWGQGTLVTVSS

SEQ ID NO: 16051 - protein, 119 aa, Artificial Sequence [sequence omitted]

SEQ ID NO: 16052 - protein, 118 aa, Mus musculus
  Ab 4785 VH
EVQLQQSGPELVMPGASVKISCKASGYSFTSYYVHWVKQRPGQGLEWIGWIYPGSGHTKYNEKFKDKATLTADTSSSTAYMQLSSLTSEDSAVYYCARPPYYSNYADVWGTGTTVTVS

SEQ ID NO: 16053 - protein, 120 aa, Mus musculus; identical to SEQ ID NO: 12023

SEQ ID NO: 16054 - protein, 117 aa, Mus musculus
  Ab 4889 VH
EVQLVESGPGLVKPSQSLSLTCSVTGYSITSAYYWNWIRQFPGNKLEWMGYVSYDGSNTYNPSLKNRISITRDTSKNQFFLKLISLTTEDTATYYCAREGDYGYSDYWGQGTTLTVS

SEQ ID NO: 16055 - protein, 119 aa, Mus musculus
  Ab 4935 VH
QIQLVQSGPELVKPGASVRISCKASGYTFTSYYIHWVKQRPGQGLEWIGWIYPGNVHTKYTEKFKGKATLTADKSSSTAYMHLSSLTSEDSAVYFCVRRYGYDGDWFAYWGQGTLVTVS

SEQ ID NO: 16056 - protein, 120 aa, Artificial Sequence
  Description of Artificial Sequence: Synthetic polypeptide
  Synthetic Humanized 5038 VH polypeptide
  MOD_RES (44)..(44): Lys or Asn
  MOD_RES (49)..(49): Ile or Met
  MOD_RES (55)..(55): Asp or Ser
  MOD_RES (68)..(68): Val or Ile
  MOD_RES (72)..(72): Val or Arg
  MOD_RES (93)..(93): Thr or Val
QVQLQESGPGLVKPSQTLSLTCTVSGYSITSGFYWTWIRQHPGXGLEWXGFISYXGSNNYNPSLKNRXTISXDTSKNQFSLKLSSVTAADTAXYYCARGGGYYGNLFDYWGQGTLVTVSS

SEQ ID NO: 16057 - protein, 121 aa, Artificial Sequence; identical to SEQ ID NO: 12024
  Description of Artificial Sequence: Synthetic polypeptide

SEQ ID NO: 16058 - protein, 119 aa, Mus musculus
  Ab 5038 VH
EVKLVESGPGLVKPSQSLSLTCSVTGYSITSGFYWTWIRQFPGNKLEWMGFISYDGSNNYNPSLKNRISITRDTSKNQFFLKLNSVTTEDTATYYCARGGGYYGNLFDYWGQGTTLTVS

SEQ ID NO: 16059 - protein, 118 aa, Artificial Sequence
  Description of Artificial Sequence: Synthetic polypeptide
  Synthetic Humanized 5082 VH polypeptide
  MOD_RES (41)..(41): His or Phe
  MOD_RES (46)..(46): Leu or Val
  MOD_RES (49)..(49): Ile or Met
  MOD_RES (55)..(55): Asp or Ser
  MOD_RES (68)..(68): Val or Ile
  MOD_RES (72)..(72): Val or Arg
  MOD_RES (86)..(86): Val or Leu
QVQLQESGPGLVKPSQTLSLTCTVSGYSITSAYYWNWIRQXPGKGXEWXGYIGYXGRNTYNPSLKNRXTISXDTSKNQFSLKLSSXTAADTAVYYCSREGDYGYSDYWGQGTLVTVSS

SEQ ID NO: 16060 - protein, 119 aa, Artificial Sequence; identical to SEQ ID NO: 12025
  Description of Artificial Sequence: Synthetic polypeptide

SEQ ID NO: 16061 - protein, 117 aa, Mus musculus
  Ab 5082 VH
EVQLKESGPGLVKPSQSLSLTCSVTGYSITSAYYWNWIRQFPGNKVEWMGYIGYDGRNTYNPSLKNRISITRDTSKNQFFLKLNSLTTEDTATYYCSREGDYGYSDYWGQGTTLTVS

SEQ ID NO: 16062 - protein, 122 aa, Mus musculus; identical to SEQ ID NO: 12026

SEQ ID NO: 16063 - protein, 113 aa, Mus musculus
  Ab 5101 VH
EVKLVESGGGLVKPGGSLKLSCAASGFTFSSYGMSWVRQTPEKRLEWVATIRDGGGYTYYSDNVKGRFTISRDNAQNNLYLQMSHLKSEDTAMYYCARGILDYWGQGTSVTVS

SEQ ID NO: 16064 - protein, 113 aa, Mus musculus
  Ab 5106 VH
EVKLVESGGDLVKPGESLKLSCAASGFTFSSFAMSWVRQTPEKRLEWVATISDGGSHLYYPDNVKGRFTISRDNAKNNLYLQMSHLKSEDTAMYYCARGILDYWGQGTSVTVS

SEQ ID NO: 16065 - protein, 118 aa, Mus musculus
  Ab 5143 VH
QVQLQQSGPELVKPGASVKISCKASGYSFTSYYIHWVKQRPGQGLEWIGWIYPGSGHTKYNEKFKGKATLTADTSSSTAYMQLSSLTSEDSAVYYCARPPYYSNYADVWGTGTTVTVS

SEQ ID NO: 16066 - protein, 117 aa, Mus musculus
  Ab 5144 VH
QVQLKESGPGLVAPSQSLSITCTVSGFSLSRYSVHWVRQPPGKGLEWLGMIWGGGSTDYNSALKSRLNINKDNSKSQVFFKMNSLQTDDTAMYYCVRKGITTTGFDYWGQGTTLTVS

SEQ ID NO: 16067 - protein, 117 aa, Mus musculus
  Ab 5259 VH
EVQLVESGPGLVAPSQSLSITCTVSGFSLSRYTIHWVRQPPGKGLEWLGMIWGGGSTDYNSALKSRLSISKDNSKSQLFLKMNSLQTDDTAIYYCARKGITTTGFDYWGQGTTLTVS

SEQ ID NO: 16068 - protein, 120 aa, Artificial Sequence
  Description of Artificial Sequence: Synthetic polypeptide
QVQLQESGPGLVKPSQTLSLTCTVSGYSITSGFYWTWIRQHPGKGLEWMGFISYSGSNNYNPSLKNRITISVDTSKNQFSLKLSSVTAADTAVYYCARGGGYYGNLFDYWGQGTLVTVSS

SEQ ID NO: 16069 - protein, 120 aa, Artificial Sequence
  Description of Artificial Sequence: Synthetic polypeptide
QVQLQESGPGLVKPSQTLSLTCTVSGYSITSGFYWTWIRQHPGNGLEWIGFISYSGSNNYNPSLKNRVTISVDTSKNQFSLKLSSVTAADTATYYCARGGGYYGNLFDYWGQGTLVTVSS

SEQ ID NO: 16070 - protein, 118 aa, Artificial Sequence
  Description of Artificial Sequence: Synthetic polypeptide
QVQLQESGPGLVKPSQTLSLTCTVSGYSITSAYYWNWIRQHPGKGVEWMGYIGYSGRNTYNPSLKNRVTISRDTSKNQFSLKLSSVTAADTAVYYCSREGDYGYSDYWGQGTLVTVSS

SEQ ID NO: 16071 - protein, 118 aa, Artificial Sequence
  Description of Artificial Sequence: Synthetic polypeptide
QVQLQESGPGLVKPSQTLSLTCTVSGYSITSAYYWNWIRQFPGKGVEWMGYIGYSGRNTYNPSLKNRVTISRDTSKNQFSLKLSSVTAADTAVYYCSREGDYGYSDYWGQGTLVTVSS

SEQ ID NO: 16072 - protein, 121 aa, Artificial Sequence
  Description of Artificial Sequence: Synthetic polypeptide
QVQLVQSGAEVKKPGASVKVSCKASGYTFTSYWMQWVRQAPGQGLEWMGNINPSNGGTSFNEEFKSRVTMTRDTSTSTVYMELSSLRSEDTAVYYCARDGGLYDGYYFDFWGQGTLVTVSS

SEQ ID NO: 16073 - protein, 123 aa, Homo sapiens
QVQLQQSGPGLVKPSETLSLTCTVSGYSISSGYFWGWIRQPPGKGLEWIGSIYQSGSTYYNPSLKSRVTISLDTSKNQFSLKLSSVTAADTAVYYCARDGYCSGGSCYPFDYWGQGTTVTVSS

SEQ ID NO: 16074 - protein, 123 aa, Homo sapiens
QVQLQESGPGLVKPSETLSLTCAVSGYSISSGYFWGWIRQPPGKGLEWIGSIYQSGSTYYNPSLKSRVTISLDTSKNQFSLKLSSVTAADTAVYYCARDGYCSGGSCYPFDYWGQGTLVTVSS

SEQ ID NO: 16075 - protein, 124 aa, Homo sapiens
QVQLQQSGAEVKMPGSSVKVSCKAFGNSFSSYATNWVRQAPGQGLEWLGWISAANGITNYGQKFQGRVTMTTDKSTDTAYMELRSLRSDDTAVYYCARTPFSENRGYYYYMDVWGKGTMVTVSS

SEQ ID NO: 16076 - protein, 124 aa, Homo sapiens
QVQLVQSGAEVKKPGASVKVSCKASGNSFSSYATNWVRQAPGQGLEWLGWISAASGITNYGQKFQGRVTMTTDKSTSTAYMELRSLRSDDTAVYYCARTPFSENRGYYYYMDVWGQGTMVTVSS

SEQ ID NO: 16077 - protein, 124 aa, Homo sapiens
QVQLQQSGAEVKMPGSSVKVSCKALGNSFSSYATNWVRQAPGQGLEWLGWISAANGITNYGQKFQGRVTMTTDKSTDTAYMELRSLRSDDTAVYYCARTPFSENRGYYYYMDVWGKGTMVTVSS

SEQ ID NO: 16078 - protein, 124 aa, Homo sapiens
QVQLQQSGAEVKMPGSSVKVSCKAFGNSFSSYATNWVRQAPGQGLEWLGWISAANGITNYGQKFQGRVTMTTDKSTDTAYMELRSLRSDDTAVYYCARTPFSENRGLQEYMDVWGKGTMVTVSS

SEQ ID NO: 16079 - protein, 124 aa, Homo sapiens
QVQLQQSGAEVKMPGSSVKVSCKAFGNSFSSYATNWVRQAPGQGLEWLGWISAANGITNYGQKFQGRVTMTTDKSTDTAYMELRSLRSDDTAVYYCARTPFSENAGFFEFMDVWGKGTMVTVSS

SEQ ID NO: 16080 - protein, 123 aa, Homo sapiens
QVQLQQSGPGLVKPSETLSLTCTVSGYSISSGYFWGWIRQPPGKGLEWIGSIYQSGSTYYNPSLKSRVTMSLDTSKNQFSLKLSSVTAADTAVYYCARDGYCSGGSCYPFDYWGQGTTVAVSS

SEQ ID NO: 16081 - protein, 123 aa, Homo sapiens
QVQLQQSGPGLVKPSETLSLTCTVSGYSISSGYFWGWVRQPPGKGLEWIGSIYQSGSTYYNPSLKSRATISLDTSKNQFSLKLSSVTAADTAVYYCARDGYCSGGGCYPFDYWGQGTTVTVSS

SEQ ID NO: 16082 - protein, 123 aa, Homo sapiens
QVQLQQSGPGLVMPSETLSLTCTVSGYSISSGYFWGWIRQPPGKGLEWIGSIYQSGSTYYNPSLKNRVTISLDTSKNQFSLKLSSVTAADTAEYYCARDGYCSGGSCYPFDYWGQGTTVTVSS

SEQ ID NO: 16083 - protein, 123 aa, Homo sapiens
QVQLQQSGPGLVEPSETLSLTCTVSGYSISSGYFWGWIRQPPGKGLEWIGSIYQSGSTYYNPSLKSRVTMSLDTSKNQFSLELSSVTAADTAVYYCARDGYCSGGSCYPLDYWGQGITVTVSS

SEQ ID NO: 16084 - protein, 123 aa, Homo sapiens
QVQLQQSGPGLVKPSESLSLTCTVSGYSVSSGYFWGWIRQPPGKGLEWIGSIYQSGSTYYNPSLKSRATMSLDASKNQFSLKLSSVTAADTAVYYCARDGYCSGGSCYPFDYWGQGTTVAVSS

SEQ ID NO: 16085 - protein, 123 aa, Homo sapiens
QVQLRQSGPGLVKPSETLSLTCTVSGYSISSGYFWGWIRQPPGKGLEWIGSIYQSGITYYNPSLKSRATISLDTSKNQFSLKLGSVTAADTAVYYCARDGYCSGGGCYPFDYWGQGTTVTVSS

SEQ ID NO: 16086 - protein, 123 aa, Homo sapiens
QVQLQESGPGLVKPSETLSLTCAVSGYSISSGYFWGWIRQPPGKGLEWIGSIYQSGITYYNPSLKSRATISLDTSKNQFSLKLSSVTAADTAVYYCARDGYCSGGGCYPFDYWGQGTLVTVSS

SEQ ID NO: 16087 - protein, 123 aa, Homo sapiens
QVQLQQSGPGLVKPSETLSLTCTVSGYSISSGYFWGWVRQPPGKGLEWIGSIYQSGSTYYNPSLKSRATISLDASKNQFSLKLSSVTAADTAVYYCARDGYCSGGGCYPFDYWGQGTTVTVSS

SEQ ID NO: 16088 - protein, 123 aa, Homo sapiens
QVQLQQSGPGLVKPSETLSLTCTVSGYSISSGYFWGWVRQPPGKGLEWIGSIYQSGSTYYNPSLKSRATISLDTSKNQFSLKLSSVTAADTAEYYCARDGYCSGGSCYPFDYWGQGTTVTVSS

SEQ ID NO: 16089 - protein, 123 aa, Homo sapiens
QVQLQQSGPGLVEPSETLSLTCTVSGYPISSGYFWGWIRQPPGKGLEWIGSIYQSGSTYYNPSLKRRVTMSLDTSKNQFSLKLSSVTAADTAVYYCARDGYCSGGSCYPFDYWGQGTTVAVSS

SEQ ID NO: 16090 - protein, 123 aa, Homo sapiens
QVQLQESGPGLVKPSETLSLTCAVSGYPISSGYFWGWIRQPPGKGLEWIGSIYQSGSTYYNPSLKRRVTMSLDTSKNQFSLKLSSVTAADTAVYYCARDGYCSGGSCYPFDYWGQGTLVTVSS

SEQ ID NO: 16091 - protein, 123 aa, Homo sapiens
QVQLQQSGPGLVKPSETLSLTCTVSGYSISSGYFWGWVRQPPGKGLEWIGSIYQSGSTYYNPSLKSRATISLDTSKNQFSLKLSSVTAADTAVYYCARDGYCSGGSCYPFDYWGQGTAVTVSS

SEQ ID NO: 16092 - protein, 123 aa, Homo sapiens
QVQLQESGPGLVKPSETLSLTCAVSGYSISSGYFWGWIRQPPGKGLEWIGSIYQSGSTYYNPSLKSRATISLDTSKNQFSLKLSSVTAADTAVYYCARDGYCSGGSCYPFDYWGQGTLVTVSS

SEQ ID NO: 16093 - protein, 123 aa, Homo sapiens
  MOD_RES (5)..(5): Gln or Arg
  MOD_RES (6)..(6): Gln or Glu
  MOD_RES (13)..(13): Lys, Met or Glu
  MOD_RES (17)..(17): Thr or Ser
  MOD_RES (23)..(23): Thr or Ala
  MOD_RES (28)..(28): Ser or Pro
  MOD_RES (29)..(29): Ile or Val
  MOD_RES (38)..(38): Ile or Val
  MOD_RES (57)..(57): Ser or Ile
  MOD_RES (66)..(66): Ser, Asn or Arg
  MOD_RES (68)..(68): Val or Ala
  MOD_RES (70)..(70): Met or Ile
  MOD_RES (74)..(74): Thr or Ala
  MOD_RES (82)..(82): Lys or Glu
  MOD_RES (84)..(84): Ser or Gly
  MOD_RES (93)..(93): Ser or Gly
  MOD_RES (106)..(106): Ser or Gly
  MOD_RES (110)..(110): Phe or Leu
  MOD_RES (117)..(117): Thr or Ile
  MOD_RES (118)..(118): Thr, Leu or Ala
  MOD_RES (120)..(120): Ala or Thr
QVQLXXSGPGLVXPSEXLSLTCXVSGYXXSSGYFWGWXRQPPGKGLEWIGSIYQSGXTYYNPSLKXRXTXSLDXSKNQFSLXLXSVTAADTAXYYCARDGYCSGGXCYPXDYWGQGXXVXVSS

SEQ ID NO: 16094 - protein, 124 aa, Homo sapiens
  MOD_RES (5)..(5): Gln or Val
  MOD_RES (13)..(13): Met or Lys
  MOD_RES (16)..(16): Ser or Ala
  MOD_RES (25)..(25): Phe, Ser or Leu
  MOD_RES (55)..(55): Asn or Ser
  MOD_RES (77)..(77): Asp or Ser
  MOD_RES (105)..(105): Arg or Ala
  MOD_RES (107)..(107): Tyr, Leu or Phe
  MOD_RES (108)..(108): Tyr, Gln or Phe
  MOD_RES (109)..(109): Tyr or Glu
  MOD_RES (110)..(110): Tyr or Phe
  MOD_RES (116)..(116): Lys or Gln
QVQLXQSGAEVKXPGXSVKVSCKAXGNSFSSYATNWVRQAPGQGLEWLGWISAAXGITNYGQKFQGRVTMTTDKSTXTAYMELRSLRSDDTAVYYCARTPFSENXGXXXXMDVWGXGTMVTVSS

SEQ ID NO: 16095 - protein, 119 aa, Artificial Sequence [sequence omitted]

SEQ ID NO: 16096 - protein, 122 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTILTGNAFDTWGQGTTVTVSS

SEQ ID NO: 16097 - protein, 122 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSS

SEQ ID NO: 16098 - protein, 122 aa, Artificial Sequence
  Description of Artificial Sequence: Synthetic polypeptide
  Synthetic consensus sequence
  MOD_RES (28)..(28): Phe, Asp, Asn, Thr, Leu, Val, Met, Glu, Arg, Ser, Ala, Trp or Pro
  MOD_RES (31)..(31): Lys, Ser, Arg, Val, His, Glu, Ile, Asn, Asp, Ala or Thr
  MOD_RES (49)..(49): Ser or Gly
  MOD_RES (53)..(53): Ser, Gly, Ala or Pro
  MOD_RES (54)..(54): Asp, Ser, Trp, Gly or Leu
  MOD_RES (59)..(59): Val, Pro, Arg, Ile or Ala
  MOD_RES (88)..(88): Ala or Pro
  MOD_RES (102)..(102): Thr, Gln, Asp, Tyr, Asn, Arg, Trp, Phe, His, Met or Lys
  MOD_RES (103)..(103): Trp, Ile, Met or Leu
  MOD_RES (111)..(111): Ser, Met, Tyr, Ile, Lys, Glu, Val, Ala, Arg, Thr or Asn
  MOD_RES (117)..(117): Ser or Thr
EVQLLQSGGGLVQPGGSLRLSCAASGFXFSXYPMHWVRQAPGKGLEWVXSISXXGGATXYADSVKGRFTISRDNSKNTLYLQMNSLRXEDTAVYYCAKDFYXXLTGNAFDXWGQGTXVTVSS

SEQ ID NO: 16099 - protein, 122 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSS

SEQ ID NO: 16100 - protein, 122 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSS

SEQ ID NO: 16101 - protein, 122 aa, Artificial Sequence
  Description of Artificial Sequence: Synthetic polypeptide
EVQLLQSGGGLVQPGGSLRLSCAASGFTFSVYPMHWVRQAPGKGLEWVSSISSSGGATRYADSVKGRFTISRDNSKNTLYLQMNSLRAEDTAVYYCAKDFYDILTGNAFDIWGQGTTVTVSS

SEQ ID NO: 16102 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRPEDTAVYYCAKDFYDMLTGNAFDKWGQGTSVTVSS

SEQ ID NO: 16103 - protein, 122 aa, Artificial Sequence
  Description of Artificial Sequence: Synthetic polypeptide
EVQLLQSGGGLVQPGGSLRLSCAASGFLFSRYPMHWVRQAPGKGLEWVSSISSSGGATPYADSVKGRFTISRDNSKNTLYLQMNSLRPEDTAVYYCAKDFYTMLTGNAFDEWGQGTTVTVSS

SEQ ID NO: 16104 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRAEDTAVYYCAKDFYYMLTGNAFDVWGQGTTVTVSS

SEQ ID NO: 16105 - protein, 122 aa, Artificial Sequence
  Description of Artificial Sequence: Synthetic polypeptide
EVQLLQSGGGLVQPGGSLRLSCAASGFVFSSYPMHWVRQAPGKGLEWVGSISSWGGATPYADSVKGRFTISRDNSKNTLYLQMNSLRPEDTAVYYCAKDFYTLLTGNAFDMWGQGTTVTVSS

SEQ ID NO: 16106 - protein, 122 aa, Artificial Sequence
  Description of Artificial Sequence: Synthetic polypeptide
EVQLLQSGGGLVQPGGSLRLSCAASGFEFSEYPMHWVRQAPGKGLEWVGSISSGGGATPYADSVKGRFTISRDNSKNTLYLQMNSLRAEDTAVYYCAKDFYNILTGNAFDAWGQGTTVTVSS

SEQ ID NO: 16107 - protein, 122 aa, Artificial Sequence
  Description of Artificial Sequence: Synthetic polypeptide
EVQLLQSGGGLVQPGGSLRLSCAASGFRFSIYPMHWVRQAPGKGLEWVSSISSSGGATAYADSVKGRFTISRDNSKNTLYLQMNSLRAEDTAVYYCAKDFYRMLTGNAFDRWGQGTSVTVSS

SEQ ID NO: 16108 - protein, 122 aa, Artificial Sequence
  Description of Artificial Sequence: Synthetic polypeptide
EVQLLQSGGGLVQPGGSLRLSCAASGFSFSNYPMHWVRQAPGKGLEWVGSISGSGGATPYADSVKGRFTISRDNSKNTLYLQMNSLRAEDTAVYYCAKDFYWMLTGNAFDTWGQGTTVTVSS

SEQ ID NO: 16109 - protein, 122 aa, Artificial Sequence
  Description of Artificial Sequence: Synthetic polypeptide
EVQLLQSGGGLVQPGGSLRLSCAASGFAFSSYPMHWVRQAPGKGLEWVGSISASGGATPYADSVKGRFTISRDNSKNTLYLQMNSLRAEDTAVYYCAKDFYQILTGNAFDYWGQGTSVTVSS

SEQ ID NO: 16110 - protein, 122 aa, Artificial Sequence
  Description of Artificial Sequence: Synthetic polypeptide
EVQLLQSGGGLVQPGGSLRLSCAASGFAFSRYPMHWVRQAPGKGLEWVGSISGWGGATPYADSVKGRFTISRDNSKNTLYLQMNSLRPEDTAVYYCAKDFYFMLTGNAFDEWGQGTSVTVSS

SEQ ID NO: 16111 - protein, 122 aa, Artificial Sequence
  Description of Artificial Sequence: Synthetic polypeptide
EVQLLQSGGGLVQPGGSLRLSCAASGFLFSSYPMHWVRQAPGKGLEWVGSISSLGGATPYADSVKGRFTISRDNSKNTLYLQMNSLRAEDTAVYYCAKDFYTWLTGNAFDMWGQGTSVTVSS

SEQ ID NO: 16112 - protein, 122 aa, Artificial Sequence
  Description of Artificial Sequence: Synthetic polypeptide
EVQLLQSGGGLVQPGGSLRLSCAASGFAFSSYPMHWVRQAPGKGLEWVGSISGSGGATPYADSVKGRFTISRDNSKNTLYLQMNSLRPEDTAVYYCAKDFYHILTGNAFDNWGQGTTVTVSS

SEQ ID NO: 16113 - protein, 122 aa, Artificial Sequence
  Description of Artificial Sequence: Synthetic polypeptide
EVQLLQSGGGLVQPGGSLRLSCAASGFWFSDYPMHWVRQAPGKGLEWVGSISSSGGATPYADSVKGRFTISRDNSKNTLYLQMNSLRPEDTAVYYCAKDFYNILTGNAFDRWGQGTSVTVSS

SEQ ID NO: 16114 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRAEDTAVYYCAKDFYMILTGNAFDTWGQGTTVTVSS

SEQ ID NO: 16115 - protein, 122 aa, Artificial Sequence
  Description of Artificial Sequence: Synthetic polypeptide
EVQLLQSGGGLVQPGGSLRLSCAASGFPFSAYPMHWVRQAPGKGLEWVSSISASGGATPYADSVKGRFTISRDNSKNTLYLQMNSLRAEDTAVYYCAKDFYKILTGNAFDMWGQGTSVTVSS

SEQ ID NO: 16116 - protein, 122 aa, Artificial Sequence
  Description of Artificial Sequence: Synthetic polypeptide
EVQLLQSGGGLVQPGGSLRLSCAASGFPFSTYPMHWVRQAPGKGLEWVGSISSSGGATPYADSVKGRFTISRDNSKNTLYLQMNSLRAEDTAVYYCAKDFYWMLTGNAFDVWGQGTSVTVSS

SEQ ID NO: 16117 - protein, 122 aa, Artificial Sequence
  Description of Artificial Sequence: Synthetic polypeptide
EVQLLQSGGGLVQPGGSLRLSCAASGFDFSHYPMHWVRQAPGKGLEWVSSISSSGGATIYADSVKGRFTISRDNSKNTLYLQMNSLRPEDTAVYYCAKDFYWMLTGNAFDKWGQGTTVTVSS

SEQ ID NO: 16118 - protein, 122 aa, Artificial Sequence
  Description of Artificial Sequence: Synthetic polypeptide
EVQLLQSGGGLVQPGGSLRLSCAASGFLFSSYPMHWVRQAPGKGLEWVGSISPSGGATPYADSVKGRFTISRDNSKNTLYLQMNSLRPEDTAVYYCAKDFYNILTGNAFDKWGQGTSVTVSS

SEQ ID NO: 16119 - protein, 121 aa, Mus musculus
EVKLVESGGGLVQPGGSLKLSCATSGFTFSDYYMYWVRQTPEKRLEWVAYITNYGGSTYYPDTVKGRFTISRDNAKNTLYLQMSRLRSEDTAMYFCARQSNYDYDGWFAYWGQGTTVTVSS

SEQ ID NO: 16120 - protein, 121 aa, Artificial Sequence; identical to SEQ ID NO: 12296
  Description of Artificial Sequence: Synthetic polypeptide

SEQ ID NO: 16121 - protein, 116 aa, Artificial Sequence; identical to SEQ ID NO: 6688
  Description of Artificial Sequence: Synthetic polypeptide

SEQ ID NO: 16122 - protein, 137 aa, Mus musculus
  Mouse monoclonal antibody B1 Fv Heavy cha in region
EVQLVESGGGLVKPGGSLKLSCAASGFIFSDNYMYWVRQTPEKRLEWVATISDGGTYIDYSDSVKGRFTISRDNAKNNLYLQMSSLRSEDTGMYYCGRSPIYYDYAPFTYWGQGTLVTVSAAKTTPPSVYPLAPGSA

SEQ ID NO: 16123 - protein, 119 aa, Mus musculus
  Mouse monoclonal antibody B3 Variable Heavy chain (VH)
DVKLVESGGGLVQPGGSLKLSCATSGFTFSDYYMYWVRQTPEKRLEWVAYISNDDSSAAYSDTVKGRFTISRDNARNTLYLQMSRLKSEDTAIYSCARGLAWGAWFAYWGQGTLVTVSS

SEQ ID NO: 16124 - protein, 119 aa, Artificial Sequence
  Description of Artificial Sequence: Synthetic polypeptide
  Humanized B3 Variable Heavy chain (VH) (HumB3V-H)
DVKLVESGGGVVQPGRSLKLSCATSGFTFSDYYMYWVRQAPGKGLEWVAYISNDDSSAAYSDTVKGRFTISRDNSKNTLYLQMNRLRAEDTAIYSCARGLAWGAWFAYWGQGTLVTVSS

SEQ ID NO: 16125 - protein, 125 aa, Mus musculus
  Mouse monoclonal antibody B5 Fv Heavy chain region
EVKLVESGGGLVQPGGSLKLSCATSGFTFSDYYMYWVRQTPEKRLEWVAYISNGGGSTYYPDTVKGRFTIDRDNAKNTLYLQMSRLKSEDTAMYYCARGLSDGSWFAYWGQGTLVTVSSGGGGSG

SEQ ID NO: 16126 - protein, 119 aa, Artificial Sequence
  Description of Artificial Sequence: Synthetic polypeptide
  Variable heavy chain of BR96 antibody
EVNLVESGGGLVQPGGSLKVSCVTSGFTFSDYYMYWVRQTPEKRLEWVAYISQGGDITDYPDTVKGRFTISRDNAKNTLYLQMSRLKSEDTAMYYCARGLDDGAWFAYWGQGTLVTVSV

SEQ ID NO: 16127 - protein, 119 aa, Artificial Sequence
  Description of Artificial Sequence: Synthetic polypeptide
  Variable region of heavy chain of mutant BR96 H3-36
EVNLVESGGGLVQPGGSLKVSCVTSGFTFSDYYMYWVRQTPEKRLEWVAYISQGGDITDYPDTVKGRFTISRDNAKNTLYLQMSRLKSEDTAMYYCARGLADGAWFAYWGQGTLVTVSV

SEQ ID NO: 16128 - protein, 119 aa, Artificial Sequence
  Description of Artificial Sequence: Synthetic polypeptide
  Variable region of heavy chain of mutant BR96 H2-60
EVNLVESGGGLVQPGGSLKVSCVTSGFTFSDYYMYWVRQTPEKRLEWVAYISQDGDITDYPDTVKGRFTISRDNAKNTLYLQMSRLKSEDTAMYYCARGLDDGAWFAYWGQGTLVTVSV

SEQ ID NO: 16129 - protein, 119 aa, Artificial Sequence
  Description of Artificial Sequence: Synthetic polypeptide
  Variable region of heavy chain of mutant BR96 H1-4-3
EVNLVESGGGLVQPGGSLKVSCVTSGFPFASYYMYWVRQTPEKRLEWVAYISQGGDITDYPDTVKGRFTISRDNAKNTLYLQMSRLKSEDTAMYYCARGLADGAWFAYWGQGTLVTVSV

SEQ ID NO: 16130 - protein, 119 aa, Artificial Sequence
  Description of Artificial Sequence: Synthetic polypeptide
  Variable region of heavy chain of mutant BR96 H2+H3
EVNLVESGGGLVQPGGSLKVSCVTSGFTFSDYYMYWVRQTPEKRLEWVAYISQDGDITDYPDTVKGRFTISRDNAKNTLYLQMSRLKSEDTAMYYCARGLADGAWFAYWGQGTLVTVSV

SEQ ID NO: 16131 - protein, 119 aa, Artificial Sequence
  Description of Artificial Sequence: Synthetic polypeptide
  variable region of the heavy chain of mutant BR96 M12+M2+M1
EVNLVESGGGLVQPGGSLKVSCVTSGFPFSDYYMYWVRQTPEKRLEWVAYISQDGDITDYPDTVKGRFTISRDNAKNTLYLQMSRLKSEDTAMYYCARGLADGAWFAYWGQGTLVTVSV

SEQ ID NO: 16132 - protein, 122 aa, Artificial Sequence
  Description of Artificial Sequence: Synthetic polypeptide
  BW835 VH
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCIRETVFYYYAMDYWGQGTTVTVSS

SEQ ID NO: 16133 - protein, 119 aa, Artificial Sequence
  Description of Artificial Sequence: Synthetic polypeptide
  VL311 VH
EVQLLESGGGLVQPGGSLRLSCAASGFTFSDYYMYWVRQAPEKRLEWVAYISNGGGSSHYVDSVKGRFTISRDNAKNTLYLQMNSLRAEDTALYHCARGMDYGAWFAYWGQGTLVTVSS

SEQ ID NO: 16134 - protein, 119 aa, Artificial Sequence
  Description of Artificial Sequence: Synthetic polypeptide
EVQLVESGGGVVQPGRSLRLSCSSSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSS

SEQ ID NO: 16135 - protein, 119 aa, Artificial Sequence
  Description of Artificial Sequence: Synthetic polypeptide
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSS

SEQ ID NO: 16136 - protein, 119 aa, Artificial Sequence
  Description of Artificial Sequence: Synthetic polypeptide
EVQLVESGGGVVQPGRSLRLSCSSSGFTFSDYYMYWVRQAPGKGLEWVAYMSNVGAITDYPDTVKGRFTISRDNAKNTLFLQMDSLRPEDTGVYFCARGTRDGSWFAYWGQGTPVTVSS

SEQ ID NO: 16137 - protein, 119 aa, Artificial Sequence
  Description of Artificial Sequence: Synthetic polypeptide
EVQLVESGGGVVQPGRSLRLSCSSSGFTFSDYYMYWVRQAPGKGLEWVAYMSNVGAITDYPDTVKGRFTISRDNAKSTLFLQMDSLRPEDTGVYFCARGTRDGSWFAYWGQGTPVTVSS

SEQ ID NO: 16138 - protein, 119 aa, Artificial Sequence
  Description of Artificial Sequence: Synthetic polypeptide
EVQLVESGGGVVQPGRSLRLSCSSSGFTFSDYYMYWVRQAPGKGLEWVAYMSNVGAITDYPDTVKGRFTISRDNAKSTLYLQMDSLRPEDTGVYFCARGTRDGSWFAYWGQGTPVTVSS

SEQ ID NO: 16139 - protein, 122 aa, Mus musculus
QVKLQQSGGGLVQPGGSMKLSCVVSGFTFSNYWMNWVRQSPEKGLEWIAEIRLKSNNFGRYYAESVKGRFTISRDDSKSSAYLQMINLRAEDTGIYYCTSYGNYVGHYFDHWGQGTTVTVSS

SEQ ID NO: 16140 - protein, 122 aa, Artificial Sequence
  Description of Artificial Sequence: Synthetic polypeptide
  MHLG; VH
EVQLVESGGGLVQPGGSLRLSCAASGFTFSNYWMNWVRQAPGKGLEWVAEIRLKSNNFGRYYAASVKGRFTISRDDSKNTLYLQMNSLKTEDTAVYYCTTYGNYVGHYFDHWGQGTTVTVSS

SEQ ID NO: 16141 - protein, 122 aa, Artificial Sequence
  Description of Artificial Sequence: Synthetic polypeptide
  MHLG1; VH
EVQLVESGGGLVKPGGSLRLSCAASGFTFSNYWMNWVRQAPGKGLEWVAEIRLKSNNFGRYYAASVKGRFTISRDDSKNTLYLQMNSLKTEDTAVYYCTTYGNYVGHYFDHWGQGTTVTVSS

SEQ ID NO: 16142 - protein, 112 aa, Artificial Sequence
  Description of Artificial Sequence: Synthetic polypeptide
  Synthetic VH MCSP clone M4-3 (C1) polypeptide
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSS

SEQ ID NO: 16143 - protein, 112 aa, Artificial Sequence
  Description of Artificial Sequence: Synthetic polypeptide
  Synthetic VH MCSP clone M4-3 (D6) polypeptide
QVQLQESGPGLVKPSQTLSLTCTVSGGSITSGYYWNWIRQHPGKGLEWIGYITFDGKNNYNPSLKSRVTISRDTSKNQFSLKLSSVTAADTAVYYCADFDYWGQGTLVTVSS

SEQ ID NO: 16144 - protein, 112 aa, Artificial Sequence
  Description of Artificial Sequence: Synthetic polypeptide
  VH MCSP clone M4-3 (A7) polypeptide
QVQLQESGPGLVKPSQTLSLTCTVSGGSITDGYYWNWIRQHPGKGLEWIGYITFDGRNNYNPSLKSRVTISRDTSKNQFSLKLSSVTAADTAVYYCADFDYWGQGTLVTVSS

SEQ ID NO: 16145 - protein, 112 aa, Artificial Sequence
  Description of Artificial Sequence: Synthetic polypeptide
  VH MCSP clone M4-3 (B7) polypeptide
QVQLQESGPGLVKPSQTLSLTCTVSGGSITSGYYWNWIRQHPGKGLEWIGYITFDGINNYNPSLKSRVTISRDTSKNQFSLKLSSVTAADTAVYYCADFDYWGQGTLVTVSS

SEQ ID NO: 16146 - protein, 112 aa, Artificial Sequence
  Description of Artificial Sequence: Synthetic polypeptide
  VH MCSP clone M4-3 (B8) polypeptide
QVQLQESGPGLVKPSQTLSLTCTVSGGSITSGYYWNWIRQHPGKGLEWIGYITFDGRNNYNPSLKSRVTISRDTSKNQFSLKLSSVTAADTAVYYCADFDYWGQGTLVTVSS

SEQ ID NO: 16147 - protein, 113 aa, Artificial Sequence
  Description of Artificial Sequence: Synthetic polypeptide
  73R009 Heavy chain variable region amino acid sequence
QVQLQESGPGLVKPSETLSLTCTVTGTTITASYAWSWIRQPPGKGLEWMGYISYSGGTDYNPSLKSRITISRDTFKNQFSLKLSSVTAADTATYYCARKGAYWGQGTLVTVSS

SEQ ID NO: 16148 - protein, 117 aa, Artificial Sequence
  Description of Artificial Sequence: Synthetic polypeptide
  Synthetic amino acid sequence of antibody CH01 - VH
EVQLLESGGGLVQPGGSLRLSCAASGFTFSPYAMSWVRQAPGKGLEWVSAITGQGGVTYYADSVKGRFTISRDNSKNTLYLQMNSLRAEDTAVYYCAKISSFHFDYWGQGTLVTVSS

SEQ ID NO: 16149 - protein, 122 aa, Homo sapiens; identical to SEQ ID NO: 14498
  Bbbt0241  VH

SEQ ID NO: 16150 - protein, 122 aa, Homo sapiens
  Bbbt0351
EVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSASTADPLRVDYWGKGTQVTVSS

SEQ ID NO: 16151 - protein, 129 aa, Homo sapiens
  Bbbt0579
GVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDDIVVVPAANANYYYYYMDVWGQGTTVTVSS

SEQ ID NO: 16152 - protein, 123 aa, Homo sapiens
  Bbbt0626  VH
GVQLVQSGAELKKPGSSVKVSCKASGGTFSSYAISWVRQAPGQGLEWMGRIIPILGTSNYAQKFQGRVTITADERTSTAYMELSSLRSEDTAVYYCARRSSLAAADRGAFDIWGQGTMVTVSS

SEQ ID NO: 16153 - protein, 122 aa, Homo sapiens
  Bbbt0632  VH
QVQLVQSGAEVKKPGSSVKVSCKTSGGTFGTYSITWVRQAPGQGLEWMGDIVPIFGTPNYAQNFQGRVTISADVSTATVYMELSSLTSDDTAVYFCAKRGSYYGRGGWFDPWGRGTMVTVSS

SEQ ID NO: 16154 - protein, 120 aa, Homo sapiens
  Bbbt0643  VH
EVQLQESGGGLVQPGGSLRLSCAASGFKITHYTMGWVRQAPGKGLEWVSAISGSGGSTYYADSVKGRFTISRDNSKNTLYLQMNSLRAEDTAVYYCARGGGTISARFDPWGQGTTVTVSS

SEQ ID NO: 16155 - protein, 128 aa, Homo sapiens
  Bbbt0654 VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNYYYDTSAYYYVGSDYFDYWGQGTMVTVSS

SEQ ID NO: 16156 - protein, 128 aa, Homo sapiens
  Bbbt0671
EVHLLESGGGLVQPGGSLRLSCAASGFTFSSYAMSWVRQAPGKGLEWVSAISGSGGSTYYAHSVKGRFTISRDNSKNTLYLQMNSLRAEDTAVYYCAKNYYYDTSAYYYVGSDYFDYWGQGTMVTVSS

SEQ ID NO: 16157 - protein, 122 aa, Homo sapiens
  Bbbt0674  VH
EVQLLESGGGLVQPGGSLRLSCAASGFKITHYTMGWVRQAPGKGLEWVSRITWGGDNTFYSNSVKGRFTISRDNSKNTLYLQMNSLRAEDTAVYYCAKETTNLYHYYGMNDWGRGTLVTVSS

SEQ ID NO: 16158 - protein, 120 aa, Homo sapiens
  Bbbt0726  VH
QVQLQQSGAEVKKPGSSVRVSCKASGGTFNSYAINWVRQAPGQGLEWMGGIITFFGTTTYAQKFQGRVTITADESTSTAYMELSSLRSDDTAVYYCARNPRIVGGAFDIWGKGTTVTVSS

SEQ ID NO: 16159 - protein, 119 aa, Homo sapiens
  Bbbt0727  VH
QVQLVQSGAEVKKPGSSVKVSCKASGDTFRSYIISWVRQAPGQGLEWVGGIIPMFGTSNYAQQFQGKVTITADESTSTAYMELSSLRSEDTAVYYCARGGARYYYMDVWGRGTMVTVSS

SEQ ID NO: 16160 - protein, 120 aa, Homo sapiens
  Bbbt0732  VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRRRDYYYDMDVWGQGTMVTVSS

SEQ ID NO: 16161 - protein, 122 aa, Homo sapiens
  Bbbt0754  VH
EVQLLESGGGLVQPGGSLRLSCAASGFKITHYTMGWVRQAPGKGLEWVSRITWGGDNTFYSNSVRGRFTISRDNSKNTLYLQMNSLRAEDTAVYYCATGTFGELFPDYFKYWGRGTMVTVSS

SEQ ID NO: 16162 - protein, 120 aa, Homo sapiens
  Bbbt0755  VH
EVQLLESGGGLVQPGGSLRLSCAASGFTFSSYAMSWVRQAPGKGLEWVSRITWGGDNTFYSNSVKGRFTISRDNSKNTLYLQMNSLRAEDTAVYYCASHYGGWISLFDHWGQGTTVTVSS

SEQ ID NO: 16163 - protein, 116 aa, Artificial Sequence
  Description of Artificial Sequence: Synthetic polypeptide
  VH Sequence
QIQLVQSGPELKKPGETVKISCKASGYTFTNYGMNWVKQAPGKGLKWMGWITTNTGEPTYAEEFKGRFAFSLETSASTAYLQINNLKNEDTATYFCARRAFAMDYWGQGTSVTVSS

SEQ ID NO: 16164 - protein, 119 aa, Artificial Sequence; identical to SEQ ID NO: 12331
  Description of Artificial Sequence: Synthetic polypeptide

SEQ ID NO: 16165 - protein, 119 aa, Artificial Sequence; identical to SEQ ID NO: 12334
  Description of Artificial Sequence: Synthetic polypeptide

SEQ ID NO: 16166 - protein, 119 aa, Mus sp.; identical to SEQ ID NO: 12330

SEQ ID NO: 16167 - protein, 118 aa, Artificial Sequence
  Description of Artificial Sequence: Synthetic polypeptide
  Synthetic amino acid sequence of antibody 1E1- VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKHEPYIGFDYWGQGTLVTVSS

SEQ ID NO: 16168 - protein, 116 aa, Artificial Sequence
  Description of Artificial Sequence: Synthetic polypeptide
  Synthetic amino acid sequence of antibody LG1 - VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKHTPSFDYWGQGTLVTVSS

SEQ ID NO: 16169 - protein, 116 aa, Artificial Sequence
  Description of Artificial Sequence: Synthetic polypeptide
  Synthetic amino acid sequence of antibody LG2 - VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKARYPFDYWGQGTLVTVSS

SEQ ID NO: 16170 - protein, 116 aa, Artificial Sequence
  Description of Artificial Sequence: Synthetic polypeptide
  Synthetic amino acid sequence of antibody LG3 - VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRARLFDYWGQGTLVTVSS

SEQ ID NO: 16171 - protein, 115 aa, Artificial Sequence
  Description of Artificial Sequence: Synthetic polypeptide
  anti-PSMA single variable domain heavy chain (clone J591) VH
EVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSS

SEQ ID NO: 16172 - protein, 119 aa, Mus musculus
EVQLQQSGAELVKPGASVKLSCTTSGFNIKATYIHWVQQRPEQGLEWIGRIDPANGNTKYDSKFQGKATITADTSSNTAYLQLSSLTSEDTAVYFCARSLHYYVFFDYWGQGTTLTVSS

SEQ ID NO: 16173 - protein, 120 aa, Mus musculus
EVQLQQSGTELVKPGASVKLSCTLFGFNIKATYMHWVRQRPEQGLEWIGRIDPPNGNTKYDPKFQDKATIKVDTSSNTAYLQLSSLTSEDTAVYYCAREFNRYDVWLAYWGQGTLVTVSA

SEQ ID NO: 16174 - protein, 120 aa, Mus musculus
EVQLQQSGAELVKPGASVKLSCTASGFKIKDTYMHWVRQRPEQGLEWIGRIDSANGNIKYDPKFQGKATITADTSSKTAYLHLSSLTFEDTAVYYCSRPKSNYDFWLPYWGQGTLVTVSA

SEQ ID NO: 16175 - protein, 120 aa, Mus musculus
EVQLQQSGAELVKPGASVKLSCTASGFNLKGTYIHWVKQRPGQGLEWIGRIDPANANTKYDPKFQGKATIRTDTSSNTAYLQLSSLTSEDTAVYFCSSPSGHYDVWFAYWGQGTLVTVSP

SEQ ID NO: 16176 - protein, 126 aa, Mus musculus
DVKLVESGGGLVKPGGSLKLSCAASGFTFSSYTMSWVRQTPEKRLEWVATISSGGSYTYYPDSVKGRFTISRDNAKNTLYLQMSSLKSEDTAMYYCTRDWDYYGTTYVGGYAMDYWGQGTSVTVSS

SEQ ID NO: 16177 - protein, 118 aa, Mus musculus
QVQLQQSGAELASPGASVKLSCKASGYTFTTYWLQWVKQRPGQGLEWIGAIYPGPGNTKYTQKFKDKATLTADKSASTAYMQLNSLTSEDSAVYYCARRGSRRGIAYWGQGTLVTVSA

SEQ ID NO: 16178 - protein, 118 aa, Mus musculus
QVQLQQSGAELASPGASVKLSCKTSGYTFTTYWLQWVKQRPGQGLEWIGAIYPGPGNTKYTQKFKDKATLTADKSASTAYMQLSSLTSEDSAVYYCARRGSRRGIAYWGQGTLVTVSA

SEQ ID NO: 16179 - protein, 117 aa, Mus musculus
DVQLQESGPDLVKPSQSLSLTCTVTGYSITSAYSWHWIRQFPGNKLEWMGYIHFSGVTNYNPSLKSRISITRDASKNQFFLQLSSVTTEDTATYYCATRRETGFTYWGQGTLVTVSA

SEQ ID NO: 16180 - protein, 112 aa, Oryctolagus cuniculus
QSVEESGGRLVTPGTPLTLTCTVSGFSLSSGVVSWVRQAPGKGLEWIGYAWSGGATYYASWAKGRFTISKSSTTVDLKITSPTTADTATYFCARGYNGMDPWGPGTLVTVSS

SEQ ID NO: 16181 - protein, 112 aa, Oryctolagus cuniculus
QSVEESGGRLVTPGTPQTLTCTVSGFSLSTDVVSWVRQAPGKGLEWIGYTWNGGATYYASWAKGRFTFSKTSTTVDLKITSPTTEDTATYFCARGYNGMDPWGPGTLVTVSS

SEQ ID NO: 16182 - protein, 117 aa, Oryctolagus cuniculus
QEQLQESGGGLITPGGTLTLTCTASGFSFNRNALSWVRQAPGKGLEWIGYIYSGGSPYYANWAKGRFNVSRTSTTVDLRMTSLTTEDTATYFCARHVSGGGWYLDIWGPGTLVTVSL

SEQ ID NO: 16183 - protein, 117 aa, Oryctolagus cuniculus
QSVEESGGRLVTPGTPLTLTCTVSGFSLYTNLINWVRQAPGKGLEWIGYINYGASAYYANWAKGRFTISQTSSTTVDLKMTSLTIEDTATYFCARGYGNDWDRLDLWGQGTLVTVSS

SEQ ID NO: 16184 - protein, 117 aa, Oryctolagus cuniculus
QSVEESGGRLVTPGTPLTLTCTFSGFSLSNNAINWVRQAPGKGLEWIGYTWSGGGTYCASWAKGRFTISKTSSTTVDLKMTSLTTEDTATYFCARAYDSEWDRLDLWGQGTLVTVSS

SEQ ID NO: 16185 - protein, 118 aa, Oryctolagus cuniculus
QEQLKESGGGLVTPGGTLTLTCTASGFYLSSNGMSWVRQAPGKGLEWIGYIYSGGSPYYASWAKGRFTISKTSSTTVDLKMTSLTTEDTATYFCARHASGGGWYLDIWGPGTLVTVSF

SEQ ID NO: 16186 - protein, 116 aa, Oryctolagus cuniculus
QSVKESGGGLVTPGGTLTLTCTASGFSLSNNAMSWVRQAPGKGLEWIGYIYPGGSPYYANWAKGRFTISRTSTTVDLKMTSLTTEDTATYFCARHVSDGGWYLYIWGPGTLVTVSL

SEQ ID NO: 16187 - protein, 112 aa, Oryctolagus cuniculus
QSLEESGGRLVTPGTPLTLTCTVSGFSLSKYEINWVRQAPGKGLEWIGYIDVGSGTWYASWAKGRFTISKTSTTVALRITSPTTEDTATYFCSRQYNPMDLWGPGTLVTVSS

SEQ ID NO: 16188 - protein, 112 aa, Oryctolagus cuniculus
QSLEESGGRLVKPDETLTLTCTVSGFSLYNYEINWVRQAPGKGLEWIGYIDVGSGTWYASWAKGRFTISKTSTTVDLKITSPTTEDTATYFCTRKYNPMDLWGPGTLVTVSS

SEQ ID NO: 16189 - protein, 118 aa, Oryctolagus cuniculus
QEQLKESGGGLVTPGGTLTLTCTASGFSLSSDGMSWVRQAPGKGLEWIGYIYSGSSPYYANWAKGRFTISKTSSTTVDLKMTSLTTEDTATYFCARHGSGGGWYLDIWGPGTLVTVSS

SEQ ID NO: 16190 - protein, 117 aa, Oryctolagus cuniculus
QEQLKESGGGLVTPGGTLTLTCTASGFSLNTNAMSWVRQAPGKGLEWIGYIYSGGSPYYANWAKGRFTISRTSTTVHLKMTSLTTEDTATYFCASHTSGGGWYLDIWGPGTLVTVSL

SEQ ID NO: 16191 - protein, 117 aa, Oryctolagus cuniculus
QSVKESGGGLVTPGGTLTLTCTASGLSLSGNGMSWVRQAPGKGLEWIGYIYSGSSPYYASWAKGRFTISKTSSTTVDLKMTSLTTEDTATYFCARHTSGGGWYLDIWGPGTLVTVSL

SEQ ID NO: 16192 - protein, 112 aa, Oryctolagus cuniculus
QSVEESGGRLVTPGTPLTLTCTVSGFSLSSDVMSWVRQAPGKGLDWIGYIWSGGRPYYANWAKGRFTISKSSSTTVDLKITSPTTEDTAAYFCARGFGSSGLNIWGPGTLVT

SEQ ID NO: 16193 - protein, 118 aa, Oryctolagus cuniculus
QSLEESGGRLVTPGTPLTLTCTVSGIDLSSSLMTWVRQAPGKGLEWIGYIWSGGAPFYASWAKGRFTISKTSSTTVDLKMTSLTTEDTATYFCAARYTDSGFDALDPWGPGTLVTVSS

SEQ ID NO: 16194 - protein, 118 aa, Oryctolagus cuniculus
QDQLKESGGGLVTPGGTLTLTCTASGFSLGSNGMSWVRQAPGKGLEWIGYIYSGSSPYYASWAKGRFTISKTSSTTVDLKMTSLTTEDTATYFCAGHAKGGGWYLDIWGPGTLVTVSL

SEQ ID NO: 16195 - protein, 115 aa, Oryctolagus cuniculus
QSVEESGGRLVTPGTPLTLTCTVSGFSLSNDVMSWVRQAPGKGLEWIGYIWSGGSPYYANWAKGRFTISKSSSTTVDLKITSPTTEDTAAYFCARGFGSSGLNIWGPGTLVTVSL

SEQ ID NO: 16196 - protein, 117 aa, Oryctolagus cuniculus
QEQLKESGGGLVTPGGTLTLTCTASRFSLINIGMSWVRQAPGRGLEWIGYIYSGGSPYYANWAKGRFTISRTSTTVDLKMTSLTTEDTATYFCARHASDGGWYLDIWGPGTLVTVSL

SEQ ID NO: 16197 - protein, 118 aa, Oryctolagus cuniculus
QSLEESGGDLVKPGASLTLTCTASGFSFSRYVCWVRQAPGKGLEWIGCIAAGSSGYTYYASWAKGRLTISKTSSTTLTLQMTSLTVADTATYFCARSGDSYVGYFNLWGPGTLVTVSS

SEQ ID NO: 16198 - protein, 112 aa, Oryctolagus cuniculus
QSVEESGGRLVTPGTPLTLTCTVSGFSLSSGVVSWVRQAPGKGLEWIGYAWSGGPTYYANWAKGRFTISKSSTTVDLKITSPTTADTATYFCARGYNGMDPWGPGTLVTVSS

SEQ ID NO: 16199 - protein, 112 aa, Oryctolagus cuniculus
QSVEESGGRLVTPGTPLTLTCTVSGFSLSTDVVSWVRQAPGKGLEWIGYTWNGGATFYASWAKGRFTFSKTSTTVDLKITSPTTEDTATYFCARGYNGMDPWGPGTLVTVSS

SEQ ID NO: 16200 - protein, 115 aa, Artificial Sequence
  Description of Artificial Sequence: Synthetic polypeptide
  Humanized VH rabbit antibody clone 408
EVQLVESGGGLVQPGGSLRLSCAVSGFSLSTDVVSWVRQAPGKGLEWIGYTWNGGATFYASWAKGRFTFSKDSSKNTVYLQMNSPRAEDTAVYFCARGYNGMDPWGPGTLVTVSS

SEQ ID NO: 16201 - protein, 112 aa, Oryctolagus cuniculus
QSVEESGGRLVTPGGSLTLTCTVSGFSLSNYEMNWVRQAPGKGLEWIGYIDVGSGTWYASWAKGRFTISKTSTTVDLKITSPTTEDTATYFCSRQYNPMDLWGPGTLVTVSS

SEQ ID NO: 16202 - protein, 116 aa, Oryctolagus cuniculus
QSVKESGGGLVTPGGTLTLTCTVSGFSLSRNAMSWVRQTPGKGLEWIGYIYSGSSPYYANWAKGRFTISRTSTTVDLKMTSLTTEDTATYFCARHVSDGGWYLDIWGPGTLVAVSL

SEQ ID NO: 16203 - protein, 117 aa, Oryctolagus cuniculus
QEQLKESGGGLVTPGGILTLTCTASGFSLRSNAMSWVRQAPGKGLEWIGYIYPGGAPHYASWAKGRFTISRNSTTVDLKMTSLTTEDTATYFCARHVSGGGWYLDIWGPGTLVTVSL

SEQ ID NO: 16204 - protein, 120 aa, Oryctolagus cuniculus
QSLEESGGGLVQPEGSPTLTCTAYLIDFSRYGYMCWVRQAPGKGLEWIGCIHAGRSGRTYYANWAKGRFTISKTSSTTVTLQMTSLTAADTATYFCAKSGDSYVGYFALWGPGTLVTVSS

SEQ ID NO: 16205 - protein, 112 aa, Oryctolagus cuniculus
QSLEESGGRLVTPGGSLTLTCTVSGFSLSNYEINWVRQAPGKGLEWIGYIDVGSGTWYASWAKGRFTISKTSTTVDLKITSPTTGDTATYFCSRSYNPMDLWGPGTLVTVSS

SEQ ID NO: 16206 - protein, 118 aa, Oryctolagus cuniculus
QEQLKESGGGLVTPGGTLTLTCTASGFSLSSNGMSWVRQAPGKGLEWIGYIYSGSSPYYASWAKGRFTISKTSSTTVDLKMTSLTTEDTAKYFCARHVSGGGWYLDIWGPGTLVTVSL

SEQ ID NO: 16207 - protein, 118 aa, Oryctolagus cuniculus
QEDLKESGGGLITPGGTLTLTCTGSGFSLSSDGMSWVRQAPGKGLEWIGYIYSGSSPYYANWAKGRFTISKTSSTTVDLKMTSLTTEDTATYFCARHLSGGGWYLDIWGPGTLVTVSL

SEQ ID NO: 16208 - protein, 118 aa, Oryctolagus cuniculus
QEQLKESGGGLVKPDESLTLTCTASGFSLSSNGMSWARQAPGKGLEWIGYIYAGSSPYYANWAKGRFTISKTSSTTVDLKVTSLTTEDTATYFCARHASGGGWYLAIWGPGTLVTVSL

SEQ ID NO: 16209 - protein, 118 aa, Oryctolagus cuniculus
QEQLKESGGGLVTPGGTLTLTCTASGFSLTTNGMSWVRQAPGKGLEWIGYIYSGGSPYYANWAKGRFTISKTSSTTVDLKMTSLTTEDTATYFCARHLSGGGWYLDIWGPGTLVTVSL

SEQ ID NO: 16210 - protein, 112 aa, Oryctolagus cuniculus
QSLEESGGRLVKPDETLTLTCTVSGSSLYNYEINWVRQAPGKGLEWIGYIDVGSGTWYASWAKGRFTISKTSTTVDLKITSPTTEDTATYFCTRKYNPMDLWGPGTLVTVSS

SEQ ID NO: 16211 - protein, 121 aa, Oryctolagus cuniculus
QEQLEESGGGLVKPEGSLTLTCTASGFDLSTYYYMCWVRQAPGKGLEWIACIYTGRASTYYATWAKGRFTISKTSSTTVTLQMTSLTAADTATFFCASKAGDIWYYGMDLWGPGTLVTVSS

SEQ ID NO: 16212 - protein, 113 aa, Oryctolagus cuniculus
QSVEESGGRLITPGTPLTLTCTVSGFSLSTDVVSWVRQAPGTGLEWIGYTWSGGSTYYAIWAKGRFTISKTSSTTVDLKITSPTTEDTATYFCARGFNPFDPWGPGTLVTVSS

SEQ ID NO: 16213 - protein, 113 aa, Oryctolagus cuniculus
QSLEESGGRLVTPGTPLTLTCTASGFTISTDVISWVRQAPGKGLEWIGYTWSGGSTYYANWAKGRFTLSKTSSTTVDLKITSPTIEDTATYFCARGFNPFDPWGPGTLVTVSS

SEQ ID NO: 16214 - protein, 115 aa, Artificial Sequence
  Description of Artificial Sequence: Synthetic polypeptide
  Humanized VH rabbit antibody clone EBI51-22
EVQLVESGGGLVQPGGSLRLSCAVSGFSLSTDVLSWVRQAPGKGLEWIGYTWSGGSTYYASWAKGRFTISKDSSKNTVYLQMNSPRAEDTAVYFCARGFNPFDPWGPGTLVTVSS

SEQ ID NO: 16215 - protein, 113 aa, Oryctolagus cuniculus
QSVEESGGRLVTPGTLLTLTCTVSGFSLSTDVLSWVRQAPGKGLEWIGYTWSGGSTYYASWAKGRFTISKTSSTTVDLKITSPTTEDTATYFCARGFNPFDPWGPGTLVTVSS

SEQ ID NO: 16216 - protein, 114 aa, Oryctolagus cuniculus
QSVKESEGGLFKPTDTLTLTCTVSGFSLSIYEISWVRQAPGKELEWIGYIGVGGVTYYANWAKSRSTITRNTNQKMVALKMTSLTAADTATYFCARGYNPFDLWGPGTLVTVSS

SEQ ID NO: 16217 - protein, 113 aa, Oryctolagus cuniculus
QSVEESGGRLVKPGESLTLTCTASGFSLSSDVISWVRQAPGKGLEWIGYGWSGGPTYYANWAKGRFTISKTSSTTVDLKITSPTTEDTATYFCARGFNPFDPWGPGTLVTVSS

SEQ ID NO: 16218 - protein, 118 aa, Artificial Sequence
  Description of Artificial Sequence: Synthetic polypeptide
QVQLVQSGAELVQPGASVKLSCKASGYTFTTYWLQWVRQTPGQGLEWMGAIYPGPGNTKYTQKFKDRVTITADTSTSTAYMQLNSLRSEDSAVYYCARRGSRRGIAYWGQGTLVTVSA

SEQ ID NO: 16219 - protein, 118 aa, Artificial Sequence
  Description of Artificial Sequence: Synthetic polypeptide
QVQLVQSGAELKKPGASVKLSCKASGYTFTTYWLQWVRQAPGQGLEWMGAIYPGPGNTKYTQKFKDRFTITADKSKSTAYMQLNSLKSEDSAVYYCARRGSRRGIAYWGQGTLVTVSA

SEQ ID NO: 16220 - protein, 118 aa, Artificial Sequence
  Description of Artificial Sequence: Synthetic polypeptide
QVQLVQSGAEVKKPGASVKVSCKASGYTFTTYWLQWVRQAPGQGLEWMGAIYPGPGNTKYTQKFKDRVTITADESTSTAYMELSSLRSEDTAVYYCARRGSRRGIAYWGQGTLVTVSA

SEQ ID NO: 16221 - protein, 118 aa, Artificial Sequence
  Description of Artificial Sequence: Synthetic polypeptide
QVQLVQSGAELKKPGASVKLSCKASGYTFTTYWLQWVRQAPGQGLEWMGAIYPGPGNTKYTQKFKDRFTITADTSKSTAYMQLNSLKSEDSAVYYCARRGSRRGIAYWGQGTLVTVSA

SEQ ID NO: 16222 - protein, 119 aa, Artificial Sequence
  Description of Artificial Sequence: Synthetic polypeptide
  Humanized VH rabbit antibody clone 23
QEQLVESGGGLVQPGGSLRLSCVASGFSLSSDGMSWVRQAPGKGLEWIGYIYSGSSPYYANWAKGRFTISKDSSTNTVFLQMNSLRAEDTAVYFCARHGDGGGWYLDIWGPGTLVTVSS

SEQ ID NO: 16223 - protein, 119 aa, Artificial Sequence
  Description of Artificial Sequence: Synthetic polypeptide
  Humanized VH rabbit anti-RANKL antibody clone 23
EVQLVESGGGLVQPGGSLRLSCAASGFSLSSDGMSWVRQAPGKGLEWIGYIYSGSSPYYANWAKGRFTISKDSSKNTVYLQMNSLRAEDTAVYFCARHGSGGGWYLDIWGPGTLVTVSS

SEQ ID NO: 16224 - protein, 119 aa, Artificial Sequence
  Description of Artificial Sequence: Synthetic polypeptide
  Humanized VH rabbit anti-RANKL antibody clone 23
EVQLVESGGGLVQPGGSLRLSCAASGFSLSSNGMSWVRQAPGKGLEWIGYIYSGGSPYYANWAKGRFTISKDSSKNTVYLQMNSLRAEDTAVYFCARHGSGGGWYLDIWGPGTLVTVSS

SEQ ID NO: 16225 - protein, 122 aa, Artificial Sequence; identical to SEQ ID NO: 10805
  Description of Artificial Sequence: Synthetic polypeptide
  Synthetic alpha-RANKL-1 heavy chain variable region

SEQ ID NO: 16226 - protein, 122 aa, Artificial Sequence
  Description of Artificial Sequence: Synthetic polypeptide
EVQLMESGGGLVQLGGSLRLSCAASGFTFSNNAMSWVRQAPGKGLEWVSAITGSGDSTYYADSVKGRFTISRDNSRNTFYLQMNSLRAEDTAVYYCAKERTGTTYLLWFDPWGQGTLVTVSS

SEQ ID NO: 16227 - protein, 122 aa, Artificial Sequence
  Description of Artificial Sequence: Synthetic polypeptide
EVQLLESGGGLVQLGGSLRLSCAASGFTFSNNAMSWVRQAPGKGLEWVSAITGSGDSTYYADSVKGRFTISRDNSRNTFYLQMNSLRAEDTAVYYCAKERTGTTYLLWFDPWGQGTLVTVSS

SEQ ID NO: 16228 - protein, 122 aa, Artificial Sequence
  Description of Artificial Sequence: Synthetic polypeptide
EVQLLESGGGLVQPGGSLRLSCAASGFTFSNNAMSWVRQAPGKGLEWVSAITGSGDSTYYADSVKGRFTISRDNSKNTLYLQMNSLRAEDTAVYYCAKERTGTTYLLWFDPWGQGTLVTVSS

SEQ ID NO: 16229 - protein, 124 aa, Artificial Sequence
  Description of Artificial Sequence: Synthetic polypeptide
QVQLVQSGGGVVQPGRSLRLSCAASGFTFSRYGMHWVRQAPGKGLEWVAVISFDTSNKYYADSVKGRCTISRDNSKNTLYLQMNSLRPEDTAVYYCAKRIAEVGYYYHYGLDVWGQGTTVTVSS

SEQ ID NO: 16230 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDTSNKYYADSVKGRCTISRDNSKNTLYLQMNSLRPEDTAVYYCAKRIAEVGYYYHYGLDVWGQGTTVTVSS

SEQ ID NO: 16231 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDTSNKYYADSVKGRFTISRDNSKNTLYLQMNSLRAEDTAVYYCAKRIAEVGYYYHYGLDVWGQGTTVTVSS

SEQ ID NO: 16232 - protein, 124 aa, Artificial Sequence
  Description of Artificial Sequence: Synthetic polypeptide
QVQLVESGGGVAQPGRSLRLSCAASGFTFNRYGMHWVRQAPGKGLEWVAVISFDGSNKYYADSVMGRFTISRDNSKNTLYLQMNSLRGEDTAVYYCAKRITEVGYYYHYGLDVWGQGTTVTVSS

SEQ ID NO: 16233 - protein, 124 aa, Artificial Sequence
  Description of Artificial Sequence: Synthetic polypeptide
QVQLVESGGGVVQPGRSLRLSCAASGFTFNRYGMHWVRQAPGKGLEWVAVISFDGSNKYYADSVKGRFTISRDNSKNTLYLQMNSLRAEDTAVYYCAKRITEVGYYYHYGLDVWGQGTTVTVSS

SEQ ID NO: 16234 - protein, 124 aa, Artificial Sequence
  Description of Artificial Sequence: Synthetic polypeptide
QVQLVESGGDVVQPGRSLRLSCTASGFTFSSYGMHWVRQAPGRGLEWVAVISFDGKNKYYADSVKGRFTVSRDNSKNTLFLQMNSLRAEDTALYYCAKRIAATGYYYFYGLDVWGQGTTVTVSS

SEQ ID NO: 16235 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVISFDGKNKYYADSVKGRFTISRDNSKNTLYLQMNSLRAEDTAVYYCAKRIAATGYYYFYGLDVWGQGTTVTVSS

SEQ ID NO: 16236 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVQGRFTISRDNSKNTLFLQMNSLGAEDTAVYYCTKRIAAAGYYYFYGMDVWGQGTTVTVSS

SEQ ID NO: 16237 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVKGRFTISRDNSKNTLYLQMNSLRAEDTAVYYCTKRIAAAGYYYFYGMDVWGQGTTVTVSS

SEQ ID NO: 16238 - protein, 124 aa, Artificial Sequence
  Description of Artificial Sequence: Synthetic polypeptide
QVQLVESGGGVVQPGRSLRLSCAASGFTFSTYGMHWVRQAPGKGLEWVAVISFDGSNKYYADSVKGRFTISRDNSKNTLYLQMNSLRAEDTAVYYCAKRIVEVGYYYHYGMDVWGQGTTVTVSS

SEQ ID NO: 16239 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVKGRFTISRDNSKNALYLQMNSLRTEDTAVYYCAKRIAAAGYYYHYGMDVWGQGTTVTVSS

SEQ ID NO: 16240 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVKGRFTISRDNSKNTLYLQMNSLRAEDTAVYYCAKRIAAAGYYYHYGMDVWGQGTTVTVSS

SEQ ID NO: 16241 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVKGRCTISRDNSKNTLYLQMNSLRPEDTAVYYCAKRIAEVGYYYHYGLDVWGQGTTVTVSS

SEQ ID NO: 16242 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVKGRFTISRDNSKNTLYLQMNSLRAEDTAVYYCAKRIAEVGYYYHYGLDVWGQGTTVTVSS

SEQ ID NO: 16243 - protein, 124 aa, Artificial Sequence
  Description of Artificial Sequence: Synthetic polypeptide
QVQLVESGGGVVQPGRSLRLSCSASGFTFTKYGMHWVRQAPGKGLEWVAVISFDGSNKYYTDSVKGRFSISRDNSNNTLYLQMNSLRAQDTAVYYCAKRIAEVGYYYHYGLDVWGQGTMVTVSS

SEQ ID NO: 16244 - protein, 124 aa, Artificial Sequence
  Description of Artificial Sequence: Synthetic polypeptide
QVQLVESGGGVVQPGRSLRLSCSASGFTFTKYGMHWVRQAPGKGLEWVAVISFDGSNKYYTDSVKGRFSISRDNSNNTLYLQMNSLRAQDTAVYYCAKRIAEVGYYYHYGLDVWGQGTTVTVSS

SEQ ID NO: 16245 - protein, 124 aa, Artificial Sequence
  Description of Artificial Sequence: Synthetic polypeptide
QVQLVESGGGVVQPGRSLRLSCAASGFTFTKYGMHWVRQAPGKGLEWVAVISFDGSNKYYADSVKGRFTISRDNSKNTLYLQMNSLRAEDTAVYYCAKRIAEVGYYYHYGLDVWGQGTTVTVSS

SEQ ID NO: 16246 - protein, 124 aa, Artificial Sequence
  Description of Artificial Sequence: Synthetic polypeptide
QVQLVESGGGVVQPGRSLRLSCAASGFTFNRYGMHWVRQAPGKGLEWVAVISFDGSNKYYADSVMGRFTISRDNSKNTLYLQMNSLRGEDTAVYYCAKRIAEVGYYYHYGMDVWGQGTTVTVSS

SEQ ID NO: 16247 - protein, 124 aa, Artificial Sequence
  Description of Artificial Sequence: Synthetic polypeptide
QVQLVESGGGVVQPGRSLRLSCAASGFTFNRYGMHWVRQAPGKGLEWVAVISFDGSNKYYADSVKGRFTISRDNSKNTLYLQMNSLRAEDTAVYYCAKRIAEVGYYYHYGMDVWGQGTTVTVSS

SEQ ID NO: 16248 - protein, 124 aa, Artificial Sequence
  Description of Artificial Sequence: Synthetic polypeptide
QVQLVESGGGVAQPGRSLRLSCAASGFTFNRYGMHWVRQAPGKGLEWVAVISFDGSNKYYADSVMGRFTISRDNSKNTLYLQMNSLRGEDTAVYYCAKRIAEVGYYYHYGMDVWGQGTTVTVSS

SEQ ID NO: 16249 - protein, 124 aa, Artificial Sequence
  Description of Artificial Sequence: Synthetic polypeptide
QVQLVESGGGVAQPGRSLRLSCAASGFTFNRYGMHWVRQAPGKGLEWVAVISFDGSNKYYVDSVMGRFTISRDNSKNTLYLQMNSLRGEDTAVYYCAKRIAEVGYYYHYGMDVWGQGTTVTVSS

SEQ ID NO: 16250 - protein, 124 aa, Artificial Sequence
  Description of Artificial Sequence: Synthetic polypeptide
QVQLVESGGGVVQPGRSLRLSCAASGFTFSNYGMHWVRQAPGKGLEWVAVISFDGKNKYYADSVQGRFTISRDNSKNTLFLQMNSLRAEDSSVYYCAKRIAVTGYYYFYGLDVWGQGTTVTVSS

SEQ ID NO: 16251 - protein, 124 aa, Artificial Sequence
  Description of Artificial Sequence: Synthetic polypeptide
QVQLVESGGGVVQPGRSLRLSCAASGFTFSNYGMHWVRQAPGKGLEWVAVISFDGKNKYYADSVKGRFTISRDNSKNTLYLQMNSLRAEDTAVYYCAKRIAVTGYYYFYGLDVWGQGTTVTVSS

SEQ ID NO: 16252 - protein, 124 aa, Artificial Sequence
  Description of Artificial Sequence: Synthetic polypeptide
QVQLVESGGGVVQPGRSLRLSCAASGFTFSRYGMHWVRQAPGKGLEWVAVISFDGSNKYYADSVKGRFTISRDNSKNALYLQMNSLRAEDTAVYYCAKRIAAAGYYYHYGMDVWGQGTTVTVSS

SEQ ID NO: 16253 - protein, 124 aa, Artificial Sequence
  Description of Artificial Sequence: Synthetic polypeptide
QVHLGESGGGVVQPGRSLRLSCAASGFTFSSYGMNWVRQAPGKGLEWVAVISFDGSNKYYADSVKGRFTISRDNSKNTLYLQMNSLRVEDSAVYYCAKRIAAAGYYYYYGLDVWGQGTTVTVSS

SEQ ID NO: 16254 - protein, 124 aa, Artificial Sequence
  Description of Artificial Sequence: Synthetic polypeptide
QVQLVESGGGVVQPGRSLRLSCAASGFTFSSYGMNWVRQAPGKGLEWVAVISFDGSNKYYADSVKGRFTISRDNSKNTLYLQMNSLRVEDSAVYYCAKRIAAAGYYYYYGLDVWGQGTTVTVSS

SEQ ID NO: 16255 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVISFDGSNKYYADSVKGRFTISRDNSKNTLYLQMNSLRAEDTAVYYCAKRIAAAGYYYYYGLDVWGQGTTVTVSS

SEQ ID NO: 16256 - protein, 124 aa, Artificial Sequence
  Description of Artificial Sequence: Synthetic polypeptide
QVQLVESGGGVVQPGRSLRLSCAASGFTFSNYGMNWVRQAPGKGLEWMAVISFDGSNKYYADSVKGRFTISRDNSKNTLYLQMNSLRPDDTAVYYCAKRIAARGYYYYYGMDVWGQGTTVTVSS

SEQ ID NO: 16257 - protein, 124 aa, Artificial Sequence
  Description of Artificial Sequence: Synthetic polypeptide
QVQLVESGGGVVQPGRSLRLSCAASGFTFSNYGMHWVRQAPGKGLEWVAVISFDGSNKYYADSVKGRFTISRDNSKNTLYLQMNSLRAEDTAVYYCAKRIAARGYYYYYGMDVWGQGTTVTVSS

SEQ ID NO: 16258 - protein, 124 aa, Artificial Sequence
  Description of Artificial Sequence: Synthetic polypeptide
QVQLVESGGGVVQPGRSLRLSCAASGFTFSTYGMHWVRQAPGKGLEWVAVISFDGSNKYFADSVKGRFTISRDNSKNTLYLQMNSLRAEDTAVYYCAKRIVQVGYYYHYGMDVWGQGTTVTVSS

SEQ ID NO: 16259 - protein, 124 aa, Artificial Sequence
  Description of Artificial Sequence: Synthetic polypeptide
QVQLVESGGGVVQPGRSLRLSCAASGFTFSTYGMHWVRQAPGKGLEWVAVISFDGSNKYYADSVKGRFTISRDNSKNTLYLQMNSLRAEDTAVYYCAKRIVQVGYYYHYGMDVWGQGTTVTVSS

SEQ ID NO: 16260 - protein, 122 aa, Artificial Sequence
  Description of Artificial Sequence: Synthetic polypeptide
EVQLVESGGGLVQPGGSLRLSCVASGFTFSNYDMHWVRQATGKGLEWVSAIGTAGDTYYPGSVKGRFTISRENAKNSLYLQMNSLRAGDTAVYYCVRDGGMVGYYYYGMDVWGQGTTVTVSS

SEQ ID NO: 16261 - protein, 122 aa, Artificial Sequence
  Description of Artificial Sequence: Synthetic polypeptide
EVQLVESGGGLVQPGGSLRLSCAASGFTFSNYDMHWVRQATGKGLEWVSAIGTAGDTYYPGSVKGRFTISRENAKNSLYLQMNSLRAGDTAVYYCVRDGGMVGYYYYGMDVWGQGTTVTVSS

SEQ ID NO: 16262 - protein, 125 aa, Artificial Sequence
  Description of Artificial Sequence: Synthetic polypeptide
EVQLLESGGGFVQPGGSLRLSCAASGFTFSSYAMSWVRQAPGKGLEWVSAISGSGGSTYYADSVKGRFTISRDNSKNTLYLQMNSLRAEDTAVYYCGKVGYCSSSSCFYYGMDVWGQGTTVTVSS

SEQ ID NO: 16263 - protein, 125 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCGKVGYCSSSSCFYYGMDVWGQGTTVTVSS

SEQ ID NO: 16264 - protein, 122 aa, Artificial Sequence
  Description of Artificial Sequence: Synthetic polypeptide
QVQLVQSGGGVVHPGRSLRLSCAASGFTFSGYGMHWVRQAPGKGLEWVAVISYDGTNEYYADSVKGRFIISRDNSKDTLYLQMNSLRPEDTAVYYCAKCLSGTYWGYGMDVWGQGTTVTVSS

SEQ ID NO: 16265 - protein, 121 aa, Artificial Sequence
  Description of Artificial Sequence: Synthetic polypeptide
QVQLVESGGGVVHPGRSLRLSCAASGFTFSGYGMHWVRQAPGKGLEWVAVISYDGTNEYYADSVKGRFIISRDNSKDTLYLQMNSLRPEDTAVYYCAKCLSGTYWGYGMDVWGQGTTVTVS

SEQ ID NO: 16266 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGTNEYYADSVKGRFTISRDNSKNTLYLQMNSLRAEDTAVYYCAKCLSGTYWGYGMDVWGQGTTVTVS

SEQ ID NO: 16267 - protein, 122 aa, Artificial Sequence
  Description of Artificial Sequence: Synthetic polypeptide
QVQLVESGGGVVHPGRSLRLSCAASGFTFSGYGMHWVRQAPGKGLEWVAVISYDATNKYYADSVKGRFTISRDNSKDTLYLQMNSLRPEDTAVYYCAKSLSGTYWGYGMDVWGQGTTVTVSS

SEQ ID NO: 16268 - protein, 121 aa, Artificial Sequence
  Description of Artificial Sequence: Synthetic polypeptide
QVQLVESGGGVVHPGRSLRLSCAASGFTFSGYGMHWVRQAPGKGLEWVAVISYDATNKYYADSVKGRFTISRDNSKDTLYLQMNSLRPEDTAVYYCAKSLSGTYWGYGMDVWGQGTTVTVS

SEQ ID NO: 16269 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDATNKYYADSVKGRFTISRDNSKNTLYLQMNSLRAEDTAVYYCAKSLSGTYWGYGMDVWGQGTTVTVS

SEQ ID NO: 16270 - protein, 122 aa, Artificial Sequence
  Description of Artificial Sequence: Synthetic polypeptide
QVQLVQSGGGVVQPGRSLRLSCAASGFTFTGYGMHWVRQAPDKGLEWVAVISYDGTNKYYVDSVKGRFTISRDNSQNTLYLQMNSLRAEDTAVYYCAKCLSGTYWGYGMDVWGQGTTVTVSS

SEQ ID NO: 16271 - protein, 121 aa, Artificial Sequence
  Description of Artificial Sequence: Synthetic polypeptide
QVQLVESGGGVVQPGRSLRLSCAASGFTFTGYGMHWVRQAPDKGLEWVAVISYDGTNKYYVDSVKGRFTISRDNSQNTLYLQMNSLRAEDTAVYYCAKCLSGTYWGYGMDVWGQGTTVTVS

SEQ ID NO: 16272 - protein, 121 aa, Artificial Sequence
  Description of Artificial Sequence: Synthetic polypeptide
QVQLVESGGGVVQPGRSLRLSCAASGFTFTGYGMHWVRQAPGKGLEWVAVISYDGTNKYYADSVKGRFTISRDNSKNTLYLQMNSLRAEDTAVYYCAKCLSGTYWGYGMDVWGQGTTVTVS

SEQ ID NO: 16273 - protein, 122 aa, Artificial Sequence
  Description of Artificial Sequence: Synthetic polypeptide
QVQLVQSGGGVVQPGRSLRLSCAASGFTFSGYGMHWVRQAPGKGLEWVAVISYDGSNKYYADSVKGRFTISRDNSKNTLYLQVNSLRAEDTAVYYCAKCLSGTYWGYGMDVWGQGTTVTVSS

SEQ ID NO: 16274 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGSNKYYADSVKGRFTISRDNSKNTLYLQVNSLRAEDTAVYYCAKCLSGTYWGYGMDVWGQGTTVTVS

SEQ ID NO: 16275 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGSNKYYADSVKGRFTISRDNSKNTLYLQMNSLRAEDTAVYYCAKCLSGTYWGYGMDVWGQGTTVTVS

SEQ ID NO: 16276 - protein, 122 aa, Artificial Sequence
  Description of Artificial Sequence: Synthetic polypeptide
QVQLVQSGGGVVQPGRSLRLSCAASGFTFSGYGMHWVRQAPDKGLEWVAVLSYDGTNKYYADSVKGRFTISRDNSKNTLYLQMNSLRAEDTAVYYCAKCLSGTYWGYGMDVWGQGTTVTVSS

SEQ ID NO: 16277 - protein, 121 aa, Artificial Sequence
  Description of Artificial Sequence: Synthetic polypeptide
QVQLVESGGGVVQPGRSLRLSCAASGFTFSGYGMHWVRQAPDKGLEWVAVLSYDGTNKYYADSVKGRFTISRDNSKNTLYLQMNSLRAEDTAVYYCAKCLSGTYWGYGMDVWGQGTTVTVS

SEQ ID NO: 16278 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVLSYDGTNKYYADSVKGRFTISRDNSKNTLYLQMNSLRAEDTAVYYCAKCLSGTYWGYGMDVWGQGTTVTVS

SEQ ID NO: 16279 - protein, 122 aa, Artificial Sequence
  Description of Artificial Sequence: Synthetic polypeptide
QVQLVQSGGGVVHPGRSLRLSCAASGFTFSGYGMHWVRQAPGKGLEWVAVISYDGTNKYYADSVKGRFTISRDNSKDTLYLQMNSLRPEDTAVYYCAKCLSGTYWGYGMDVWGQGTTVTVSS

SEQ ID NO: 16280 - protein, 121 aa, Artificial Sequence
  Description of Artificial Sequence: Synthetic polypeptide
QVQLVESGGGVVHPGRSLRLSCAASGFTFSGYGMHWVRQAPGKGLEWVAVISYDGTNKYYADSVKGRFTISRDNSKDTLYLQMNSLRPEDTAVYYCAKCLSGTYWGYGMDVWGQGTTVTVS

SEQ ID NO: 16281 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGTNKYYADSVKGRFTISRDNSKNTLYLQMNSLRAEDTAVYYCAKCLSGTYWGYGMDVWGQGTTVTVS

SEQ ID NO: 16282 - protein, 122 aa, Artificial Sequence
  Description of Artificial Sequence: Synthetic polypeptide
QVQLVQSGGGVVQPGRSLRLSCAASGFTFGGYGMHWVRQAPDKGLEWVAVISYDGNNKYYVDSVKGRFTISRDNSKNMLYLQMNSLRAEDTAVYYCAKCLSGTYWGYGMDGWGQGTTVTVSS

SEQ ID NO: 16283 - protein, 121 aa, Artificial Sequence
  Description of Artificial Sequence: Synthetic polypeptide
QVQLVESGGGVVQPGRSLRLSCAASGFTFGGYGMHWVRQAPDKGLEWVAVISYDGNNKYYVDSVKGRFTISRDNSKNMLYLQMNSLRAEDTAVYYCAKCLSGTYWGYGMDGWGQGTTVTVS

SEQ ID NO: 16284 - protein, 121 aa, Artificial Sequence
  Description of Artificial Sequence: Synthetic polypeptide
QVQLVESGGGVVQPGRSLRLSCAASGFTFGGYGMHWVRQAPGKGLEWVAVISYDGNNKYYADSVKGRFTISRDNSKNTLYLQMNSLRAEDTAVYYCAKCLSGTYWGYGMDGWGQGTTVTVS

SEQ ID NO: 16285 - protein, 122 aa, Artificial Sequence
  Description of Artificial Sequence: Synthetic polypeptide
QVQLVQSGGGVVQPGRSLRLSCAASGFTFSGYGMHWVRQAPGMGLEWVAVISYDGINKYYADSVKGRFTISRDNSKNTLFLQMNSLRAEDTALYYCAKCLSGTYWGYGMDVWGQGTTVTVSS

SEQ ID NO: 16286 - protein, 121 aa, Artificial Sequence
  Description of Artificial Sequence: Synthetic polypeptide
QVQLVESGGGVVQPGRSLRLSCAASGFTFSGYGMHWVRQAPGMGLEWVAVISYDGINKYYADSVKGRFTISRDNSKNTLFLQMNSLRAEDTALYYCAKCLSGTYWGYGMDVWGQGTTVTVS

SEQ ID NO: 16287 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGINKYYADSVKGRFTISRDNSKNTLYLQMNSLRAEDTAVYYCAKCLSGTYWGYGMDVWGQGTTVTVS

SEQ ID NO: 16288 - protein, 122 aa, Artificial Sequence
  Description of Artificial Sequence: Synthetic polypeptide
QVQLVQSGGGVVQPGRSLRLSCAASGFTFSGFGMHWVRQAPGKGLEWVAIISYDGRNKYYADSVKGRFTISRDNSKNTLYLQMNSLRAEDTAVYYCAKSLSGTYWGYGMDVWGQGTTVTVSS

SEQ ID NO: 16289 - protein, 121 aa, Artificial Sequence
  Description of Artificial Sequence: Synthetic polypeptide
QVQLVESGGGVVQPGRSLRLSCAASGFTFSGFGMHWVRQAPGKGLEWVAIISYDGRNKYYADSVKGRFTISRDNSKNTLYLQMNSLRAEDTAVYYCAKSLSGTYWGYGMDVWGQGTTVTVS

SEQ ID NO: 16290 - protein, 121 aa, Artificial Sequence
  Description of Artificial Sequence: Synthetic polypeptide
QVQLVESGGGVVQPGRSLRLSCAASGFTFSGFGMHWVRQAPGKGLEWVAVISYDGRNKYYADSVKGRFTISRDNSKNTLYLQMNSLRAEDTAVYYCAKSLSGTYWGYGMDVWGQGTTVTVS

SEQ ID NO: 16291 - protein, 122 aa, Artificial Sequence
  Description of Artificial Sequence: Synthetic polypeptide
QVQLVQSGGGVVHPGRSLRLSCAASGFTFSGYGMHWVRQAPGKGLEWVAVISYDGANKYYADSVKGRFTISRDNSKDTLYLQMNSLRPEDTAVYYCAKCLSGTYWGYGMDVWGQGTTVTVSS

SEQ ID NO: 16292 - protein, 121 aa, Artificial Sequence
  Description of Artificial Sequence: Synthetic polypeptide
QVQLVESGGGVVHPGRSLRLSCAASGFTFSGYGMHWVRQAPGKGLEWVAVISYDGANKYYADSVKGRFTISRDNSKDTLYLQMNSLRPEDTAVYYCAKCLSGTYWGYGMDVWGQGTTVTVS

SEQ ID NO: 16293 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGANKYYADSVKGRFTISRDNSKNTLYLQMNSLRAEDTAVYYCAKCLSGTYWGYGMDVWGQGTTVTVS

SEQ ID NO: 16294 - protein, 122 aa, Artificial Sequence
  Description of Artificial Sequence: Synthetic polypeptide
QVQLVESGGGVVQPGRSLRLSCAASGFTFSGYGIHWVRQAPDKGLEWVAVISYDGTNKYYGDSVKGRFTISRDNTKNTLYLQMNSLRTEDTAVYYCAKSLSGTYWGYGMDVWGQGTTVTVSS

SEQ ID NO: 16295 - protein, 121 aa, Artificial Sequence
  Description of Artificial Sequence: Synthetic polypeptide
QVQLVESGGGVVQPGRSLRLSCAASGFTFSGYGIHWVRQAPDKGLEWVAVISYDGTNKYYGDSVKGRFTISRDNTKNTLYLQMNSLRTEDTAVYYCAKSLSGTYWGYGMDVWGQGTTVTVS

SEQ ID NO: 16296 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGTNKYYADSVKGRFTISRDNSKNTLYLQMNSLRAEDTAVYYCAKSLSGTYWGYGMDVWGQGTTVTVS

SEQ ID NO: 16297 - protein, 122 aa, Artificial Sequence
  Description of Artificial Sequence: Synthetic polypeptide
QVQLVQSGGGVVQPGRSLRLSCAASGFTFSGYGMHWVRQAPGKGLDWVTVISYDGSNKHYADSVKGRFTISRDNSKNTLYLQMSSLGPEDTAVYYCAKSLSGTYWGYGMDVWGQGTTVTVSS

SEQ ID NO: 16298 - protein, 121 aa, Artificial Sequence
  Description of Artificial Sequence: Synthetic polypeptide
QVQLVESGGGVVQPGRSLRLSCAASGFTFSGYGMHWVRQAPGKGLDWVTVISYDGSNKHYADSVKGRFTISRDNSKNTLYLQMSSLGPEDTAVYYCAKSLSGTYWGYGMDVWGQGTTVTVS

SEQ ID NO: 16299 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGSNKYYADSVKGRFTISRDNSKNTLYLQMNSLRAEDTAVYYCAKSLSGTYWGYGMDVWGQGTTVTVS

SEQ ID NO: 16300 - protein, 122 aa, Artificial Sequence
  Description of Artificial Sequence: Synthetic polypeptide
QVQLVQSGGGVVQPGRSLRLSCAASGFTFSGYGIHWVRQAPDKGLEWVAVISYDGTNKYYGDSVKGRFTISRDNTKNTLYLQMNSLRTEDTAVYYCAKCLSGTYWGYGMDVWGQGTTVTVSS

SEQ ID NO: 16301 - protein, 121 aa, Artificial Sequence
  Description of Artificial Sequence: Synthetic polypeptide
QVQLVESGGGVVQPGRSLRLSCAASGFTFSGYGIHWVRQAPDKGLEWVAVISYDGTNKYYGDSVKGRFTISRDNTKNTLYLQMNSLRTEDTAVYYCAKCLSGTYWGYGMDVWGQGTTVTVS

SEQ ID NO: 16302 - protein, 122 aa, Artificial Sequence
  Description of Artificial Sequence: Synthetic polypeptide
QVQLVQSGGGVVHPGRSLTLSCAASGFTFSGYGMHWVRQAPGKGLEWVAVISYDGINKYYADSVKGRFTISRDNSKNTLYLQMNSLRAEDTAIYYCAKCLSGSYWGFGMDVWGQGTTVTVSS

SEQ ID NO: 16303 - protein, 121 aa, Artificial Sequence
  Description of Artificial Sequence: Synthetic polypeptide
QVQLVESGGGVVHPGRSLTLSCAASGFTFSGYGMHWVRQAPGKGLEWVAVISYDGINKYYADSVKGRFTISRDNSKNTLYLQMNSLRAEDTAIYYCAKCLSGSYWGFGMDVWGQGTTVTVS

SEQ ID NO: 16304 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAVISYDGINKYYADSVKGRFTISRDNSKNTLYLQMNSLRAEDTAVYYCAKCLSGSYWGFGMDVWGQGTTVTVS

SEQ ID NO: 16305 - protein, 122 aa, Artificial Sequence
  Description of Artificial Sequence: Synthetic polypeptide
EVQLLESGGGLLQPGGSLRLSCAASGFTFSGFGMSWVRQAPGRGLEWVSVISYDGRNKYYADSVKGRFTSSRDNSKNTLYLQMNSLRAEDTAVYYCAKSLSGTYWGYGMDVWGRGTLVTVSS

SEQ ID NO: 16306 - protein, 117 aa, Artificial Sequence
  Description of Artificial Sequence: Synthetic polypeptide
  RON-e01 murine VH
QVQLQQSGAELAKPGASVKMSCKSSGYTFTSYWIHWVKERPGQGLEWIGYIYPTTGYTESNQKFKDKATLTADKSSSTAYMQLSSLTSEDSAVYYCFLLRPWYFDVWGAGTTVTVSS

SEQ ID NO: 16307 - protein, 117 aa, Artificial Sequence
  Description of Artificial Sequence: Synthetic polypeptide
  RON-e01h10 humanized VH
QVQLVQSGAEVKKPGASVKVSCKASGYTFTSYWIHWVRQAPGQGLEWIGYIYPTTGYTESNQKFKDRVTMTRDTSTSTVYMELSSLRSEDTAVYYCFLLRPWYFDVWGQGTTVTVSS

SEQ ID NO: 16308 - protein, 117 aa, Artificial Sequence
  Description of Artificial Sequence: Synthetic polypeptide
  RON-e01h8 humanized VH
QVQLVQSGAEVKKPGASVKVSCKASGYTFTSYWIHWVRQAPGQGLEWIGYIYPTTGYTESNQKFKDRVTMTRDTSISTAYMELSRLRSDDTAVYYCFLLRPWYFDVWGQGTTVTVSS

SEQ ID NO: 16309 - protein, 117 aa, Artificial Sequence
  Description of Artificial Sequence: Synthetic polypeptide
  RON-e01h9 humanized VH
QVQLVQSGAEVKKPGASVKVSCKASGYTFTSYWIHWVRQATGQGLEWIGYIYPTTGYTESNQKFKDRVTMTRNTSISTAYMELSSLRSEDTAVYYCFLLRPWYFDVWGQGTTVTVSS

SEQ ID NO: 16310 - protein, 121 aa, Artificial Sequence
  Description of Artificial Sequence: Synthetic polypeptide
  RON-f01 murine VH
QIQLQQSGPELVKPGTSVKISCKASDYTLTDFYMNWVRQKPGQGLEWIGRIYPGTDKTRYNEKFRDKAILTVDTSSSTAYMQLSSLTSEDTAVYFCARSAYYGNYVAMDYWGQGTSVTVSL

SEQ ID NO: 16311 - protein, 121 aa, Artificial Sequence
  Description of Artificial Sequence: Synthetic polypeptide
  RON-f01 murine VH variant
QIQLQQSGPELVKPGTSVKISCKASDYTLTDFYMNWVRQKPGQGLEWIGRIYPGTDKTRYNEKFRDKAILTVDTSSSTAYMQLSSLTSEDTAVYFCARSAYYGNYVAMDYWGQGTSVTVSS

SEQ ID NO: 16312 - protein, 121 aa, Artificial Sequence
  Description of Artificial Sequence: Synthetic polypeptide
  RON-f01h4 humanized VH; hu4C04 VH
EVQLVQSGAEVKKPGATVKISCKVSDYTLTDFYMNWVQQAPGKGLEWIGRIYPGTDKTRYNEKFRDRVTITADTSTDTAYMELSSLRSEDTAVYYCARSAYYGNYVAMDYWGQGTTVTVSS

SEQ ID NO: 16313 - protein, 121 aa, Artificial Sequence
  Description of Artificial Sequence: Synthetic polypeptide
  RON-f01h5 humanized VH
QVQLVQSGAEVKKPGSSVKVSCKASDYTLTDFYMNWVRQAPGQGLEWIGRIYPGTDKTRYNEKFRDRVTITADKSTSTAYMELSSLRSEDTAVYYCARSAYYGNYVAMDYWGQGTTVTVSS

SEQ ID NO: 16314 - protein, 91 aa, Artificial Sequence
  Description of Artificial Sequence: Synthetic polypeptide
  Variable Heavy Chain - Clone AE8
AVTLDESGGGLQTPGGGLSLVCKASGFTFDSYAMYWVRQAPGKGLEWVASINRFGSSTGHGAAVKGRATISRDNGQSTLGAYPYDVPDYAS

SEQ ID NO: 16315 - protein, 153 aa, Artificial Sequence
  Description of Artificial Sequence: Synthetic polypeptide
  Variable Heavy Chain - Clone AE9
AVTLDESGGGLQTPGGALSLICKASGFTFSSFNMIWVRQAPGKGLEFVGSINRFGNSTGHGAAVKGRVTISRDDGQSTVRLQLNNLRAEDTGTYFCAKSVHGHCASGYWCSAASIDAWGHGTEVIVSSTSGQAGQHHHHHHGAYPYDVPDYAS

SEQ ID NO: 16316 - protein, 148 aa, Artificial Sequence
  Description of Artificial Sequence: Synthetic polypeptide
  Variable Heavy Chain - Clone CD3
AVTLDESEGGLQTPGGALSLVCKASGFSFSDRGMHWVRQAPGKGLEYVAGIYDDGGTTYYGAAVKGRASITRDNGQSAVRLQLNNLRAEDTATYYCAKSAAGDAWGADDIDAWGHGTEVIVSSTSGQAGQHHHHHHGAYPYDVPDYAS

SEQ ID NO: 16317 - protein, 153 aa, Artificial Sequence
  Description of Artificial Sequence: Synthetic polypeptide
  Variable Heavy Chain - Clone CD11
AVTLDESGGGLQTPGGALSLVCKASGFDFSSYQMNWIRQAPGKGLEWVAAINKFGTSTSRGAAVKGRVTISRDDGQSTVRLQLNNLRSEDTATYFCAKSAYGSCASGSWCSAASIDAWGHGTEVIVSSTSGQAGQHHHHHHGAYPYDVPDYAS

SEQ ID NO: 16318 - protein, 115 aa, Artificial Sequence; identical to SEQ ID NO: 12439
  Description of Artificial Sequence: Synthetic polypeptide
  Chimeric heavy chain sequence

SEQ ID NO: 16319 - protein, 115 aa, Artificial Sequence; identical to SEQ ID NO: 12442
  Description of Artificial Sequence: Synthetic polypeptide
  Chimeric heavy chain sequence

SEQ ID NO: 16320 - protein, 142 aa, Artificial Sequence
  Description of Artificial Sequence: Synthetic polypeptide
  VH chain domain of clone 5B1
MEFGLSWLFLVAILKGVQCQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSS

SEQ ID NO: 16321 - protein, 142 aa, Artificial Sequence
  Description of Artificial Sequence: Synthetic polypeptide
  VH chain domain of clone 9H3
MEFGLSWLFLVAILKGVQCEVQLLESGGGLVQPGRSLRLSCAASGFTFDDYVMHWVRQAPGKGLEWVSSISWNSGSIGYADSVKGRFIISRDNAKNSLYLQMNSLRAEDTALYYCAKDRRIRGDSGFEGDYWGQGTLVTVSS

SEQ ID NO: 16322 - protein, 142 aa, Artificial Sequence
  Description of Artificial Sequence: Synthetic polypeptide
  VH chain domain of clone 5H11
MEFGLSWLFLVAILKGVQCQVQLLESGGGLVQPGRSLRLSCAASGFTFDEYAMHWVRQAPGKGLEWVSSVSWNSGSIGYADSVKGRFTISRDNAKNSLYLQMNSLRAEDTALYYCAKDIRTYSTGGAEFASWGQGTLVTASS

SEQ ID NO: 16323 - protein, 145 aa, Artificial Sequence
  Description of Artificial Sequence: Synthetic polypeptide
  VH chain domain of clone 7E3
MEFGLSWLFLVAILKGVQCQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSS

SEQ ID NO: 16324 - protein, 154 aa, Mus musculus
MRVLILLCLFTAFPGILSDVQLQESGPDLVKPSQSLSLTCTVTGYSITSGYSWHWVRQFPGNKMEWMGHIHFSGRPTYNPSLSSRISITRDTSKNQFLLQLKFVTTEDTSTYFCARKGKGSDDGLNYWGQGISVTVSSAKTTPPPVYPLVPGSL

SEQ ID NO: 16325 - protein, 117 aa, Artificial Sequence
  Description of Artificial Sequence: Synthetic polypeptide
  2F11; VH
EVQLLESGGGLVQPGGSLRLSCAASGFTFSSYAMSWVRQAPGKGLEWVSAISGSGGSTYYADSVKGRFTISRDNSKNTLYLQMNSLRAEDMAVYYCAKWRWMMFDYWGQGTLVTVSS

SEQ ID NO: 16326 - protein, 117 aa, Artificial Sequence
  Description of Artificial Sequence: Synthetic polypeptide
  2F11(MT); VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWRWMMFDYWGQGTLVTVSS

SEQ ID NO: 16327 - protein, 121 aa, Artificial Sequence
  Description of Artificial Sequence: Synthetic polypeptide
  2B10; 2B10_C3A6; 2B10_D1A2_wt; 2B10_D1A2_VD; 2B10_O7D8; 2B10_O1F7; 2B10_6H10; VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARLYGYAYYGAFDYWGQGTTVTVSS

SEQ ID NO: 16328 - protein, 121 aa, Artificial Sequence
  Description of Artificial Sequence: Synthetic polypeptide
  2B10_6A12; VH
QVQLVQSGAEVKKPGSSVKVSCKASGGTFSSYAISWVRQAPGQGLEWMGVIIPILGTANYAQKFQGRVTITADKSTSTAYMELSSLRSEDTAVYYCARLYGYAYYGAFDYWGQGTTVTVSS

SEQ ID NO: 16329 - protein, 121 aa, Artificial Sequence
  Description of Artificial Sequence: Synthetic polypeptide
  2B10_C3B6; VH
QVQLVQSGAEVKKPGSSVKVSCKASGGTFSSYAISWVRQAPGQGLEWMGAIIPILGIANYAQKFQGRVTITADKSTSTAYMELSSLRSEDTAVYYCARLYGYAYYGAFDYWGQGTTVTVSS

SEQ ID NO: 16330 - protein, 116 aa, Homo sapiens
  3A1-D5 VH domain amino acid sequence
EVQLLESGGGLVQPGGSLRLSCAASGFTFSSYAASWVRQAPGKGLEWVSAISGSGGSTYYADSVKGRFTISRDNSKNTLYLQMNSLRAEDTAVYYCAKAHNAFDYWGQGTLVTVSR

SEQ ID NO: 16331 - protein, 116 aa, Artificial Sequence
  Description of Artificial Sequence: Synthetic polypeptide
  Synthetic sequence: 4A1-F16 VH domain
EVQLLESGGGLVQPGGSLRLSCAASGFTFSRYGASWVRQAPGKGLEWVSAISGSGGSTYYADSVKGRFTISRDNSKNTLYLQMNSLRAEDTAVYYCAKAHNAFDYWGQGTLVTVSR

SEQ ID NO: 16332 - protein, 118 aa, Homo sapiens
  A12 VH domain amino acid sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKHPPHRPFDYWGQGTLVTVSR

SEQ ID NO: 16333 - protein, 116 aa, Homo sapiens
  D11 VH domain amino acid sequence
EVQLVESGGGLVQPGGSLRLSCAASGFTFGSYAMSWVRQAPGKGLEWVSAISGSGGSTYYADSVEGRFTISRDNSKNTLYLQMNSLRAEDTAVYYCAKGRRIFDYWGQGTLVTVSR

SEQ ID NO: 16334 - protein, 118 aa, Homo sapiens
  E10 VH domain amino acid sequence; F4 E10 VH domain amino acid sequence; F4  G11 VH domain amino acid sequence
EVQLVESGGGLVQPGGSLRLSCAASGFTFSGSRMGWVRQAPGKGLEWVSAINEEGGQTYYADSVKGRFTISRDNSKNTLYLQMNSLRAEDTAVYYCAKHPPHRPFDYWGQGTLVTVSR

SEQ ID NO: 16335 - protein, 116 aa, Artificial Sequence
  Description of Artificial Sequence: Synthetic polypeptide
  Synthetic sequence: F16 VH domain
EVQLLESGGGLVQPGGSLRLSCAASGFTFSRYGMSWVRQAPGKGLEWVSAISGSGGSTYYADSVKGRFTISRDNSKNTLYLQMNSLRAEDTAVYYCAKAHNAFDYWGQGTLVTVSR

SEQ ID NO: 16336 - protein, 118 aa, Homo sapiens
  New F4 and New F4  G11 VH domain amino acid sequence; New E10 VH domain amino acid sequence
EVQLLESGGGLVQPGGSLRLSCAASGFTFSGSRMGWVRQAPGKGLEWVSAINEEGGQTYYADSVKGRFTISRDNSKNTLYLQMNSLRAEDTAVYYCAKHPPHRPFDYWGQGTLVTVSS

SEQ ID NO: 16337 - protein, 116 aa, Homo sapiens
  F4S VH domain amino acid sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRRIFDYWGQGTLVTVSR

SEQ ID NO: 16338 - protein, 116 aa, Homo sapiens
  P12 VH domain amino acid sequence
EVQLVESGGGLVQPGGSLRLSCAASGFTFGQYSMSWVRQAPGKGLEWVSAITGTGGETYYADSVEGRFTISRDNSKNTLYLQMNSLRAEDTAVYYCAKGRRIFDYWGQGTLVTVSR

SEQ ID NO: 16339 - protein, 117 aa, Artificial Sequence
  Description of Artificial Sequence: Synthetic polypeptide
  Synthetic amino acid sequence of antibody G10 - VH
EVQLLESGGGLVQPGGSLRLSCAASGFTFSSYAMSWVRQAPGKGLEWVSAISGSGGSTYYADSVKGQFTISRDNSKNTLYLQMNSLRAEDTAVYYCAKANPWAFDYWGQGTLVTVSS

SEQ ID NO: 16340 - protein, 120 aa, Artificial Sequence
  Description of Artificial Sequence: Synthetic polypeptide
  synthetic ST2146 heavy chain variable region protein sequence
KVKLQQSGPELVKPGASVKVSCKASGYAFTSYNMYWVKQSHGKSLEWIGYIDPYNGVTSYNQKFKGKATLTVDKSSSTAYMHLNSLTSEDSAVYYCARGGGSIYYAMDYWGQGTTVTVSS

SEQ ID NO: 16341 - protein, 131 aa, Mus musculus
MDFQVQIFSFLLISASVIMSRGQIVLSQSPAILSASPGEKVTMTCRANSSVRFMHWYQQKPGSSPKPWIYATSNLASGVPARFSGSGSGTSYSVTISRVEAEDAATYYCQQWSSNSPRTFGGGTKVEIRRA

SEQ ID NO: 16342 - protein, 116 aa, Homo sapiens
QVQLVESGGGVVQPGRSLRLSCAASGFTFSNYGMHWVRQAPGKGLEWVAVIPFDGSNKYYADSVKGRFTISRDNSKNTLYLQTNSLRAEDTAVYYCARNWGYFDYWGQGTLVTVSS

SEQ ID NO: 16343 - protein, 127 aa, Homo sapiens
QVQLQESGPGLVKPSETLSLTCTVSGGSISSYYWSWIRQPPGKGLEWIGYIYYSGNTNYNPSLKSRVTISVDTSKNQFSLKLSSVTAADTAVYYCARDIVVVPAARDYDYYYGMDVWGQGTTVTVSS

SEQ ID NO: 16344 - protein, 122 aa, Homo sapiens
EVQLVQSGAEVKKPGESLKISCKDSGYSFTSYWIGWVRQMPGKGLEWMGIIYPGDSDTRYSPSFQGQVTISADKSISTAYLQWSSLKASDTAMYYCARPFFYSSGWYYFDYWGQGTLVTVSS

SEQ ID NO: 16345 - protein, 125 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKALVGATRDYYYYGMDVWGQGTTVTVSS

SEQ ID NO: 16346 - protein, 121 aa, Homo sapiens
QVQLQQWGAGLLKPSETLSLTCAVYGGSFSHYYWSWIRQPPGKGLEWIGEINHSGSTNYNPSLKSRVTISVDTSKNQFSLKLSSVTAADTAVYYCARDITMVRGLGGMDVWGQGTTVTVSS

SEQ ID NO: 16347 - protein, 125 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKAIVGARDYYYYYGMDVWGQGTTVTVSS

SEQ ID NO: 16348 - protein, 121 aa, Homo sapiens
QVQLVESGGGVVQPGRSLRLSCAASGFTFSSYGMHWVRQAPGKGLEWVAVLWYDGSKKFYADSVKGRFTISRDNSKNTLYLQMNSLRAEDTALYYCARGPWNYYYYGMDVWGQGTTVTVSS

SEQ ID NO: 16349 - protein, 121 aa, Homo sapiens
QEQLVESGGGVVQPGRSLRLSCAASGFTFSSHGMHWVRQAPGKGLEWVAIIWYDGSKKFYADSVKGRFTISRDNSKNTLSLQMNSLRAEDTAVYYCARGPWNYYYYGMDVWGQGTTVTVSS

SEQ ID NO: 16350 - protein, 120 aa, Homo sapiens
QVQLVESGGGVVQPGRSLRLSCAASGFTFSHYGMHWVRQAPGKGLEWVAVIWFDGSDKDYADSVKGRFTISRDNSKNTLYLQMNSLRAEDTAVYYCARDSSGWYAYFDYWGQGTLVTVSS

SEQ ID NO: 16351 - protein, 120 aa, Homo sapiens
QVQLVESGGGVVQPGRSLRLSCAASGFTFSSYGMHWVRQAPGKGLEWVAFIWYDGSNKYYADSVKGRFTISRDNSKNTLYLQMNSLRAEDTAVYYCARDGSSGWYFFDYWGQGTLVTVSS

SEQ ID NO: 16352 - protein, 122 aa, Homo sapiens
QVQLVQSGAEVKKPGASVKVSCKASGYTFTGYYMHWVRQAPGQGLEWMGWINPNSGGTNSAQRFQGRVTMTRDTSIYTAYMELSRLRSDDTAVYYCAREYRSGRYYNGMDVWGQGTTVTVSS

SEQ ID NO: 16353 - protein, 123 aa, Homo sapiens
QVQLVQSGAEVKKPGASVKVSCKASGYTFTNYDINWLRQASGQGLEWMGWMNPDSGNTGYAQRFQGRVTMTRDTSISTAYMELSSLRSEDTAVYYCARYISSLHYYYYGMDVWGQGTTVTVSS

SEQ ID NO: 16354 - protein, 123 aa, Homo sapiens
QVQLVQSGAEVKKPGASVKVSCKASGYTFTNYDINWVRQATGQGLEWMGWMNPNSGNTGYAQKFQGRVTMTRNTSIRTAYMELSSLRSEDTAVYYCARGPGGSFYYYYGMDVWGQGTTVTVSS

SEQ ID NO: 16355 - protein, 119 aa, Artificial Sequence
  Description of Artificial Sequence: Synthetic polypeptide
  Synthetic Construct
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSS

SEQ ID NO: 16356 - protein, 119 aa, Artificial Sequence
  Description of Artificial Sequence: Synthetic polypeptide
  Synthetic Construct
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSS

SEQ ID NO: 16357 - protein, 114 aa, Artificial Sequence
  Description of Artificial Sequence: Synthetic polypeptide
  3H4 heavy chain
QVQLEESGPGLVAPSQSLSITCTVSGFSLTSYGVSWVRQPPGKGLEWLGVIWGDGSTNYHSALISRLSISKDNSKSQVFLKLNSLQTDDTATYYCAKGGYFDYWGQGTTLTVSS

SEQ ID NO: 16358 - protein, 116 aa, Artificial Sequence
  Description of Artificial Sequence: Synthetic polypeptide
  Synthetic sequence 5E5VH
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 16359 - protein, 116 aa, Artificial Sequence
  Description of Artificial Sequence: Synthetic polypeptide
  Synthetic sequence: Humanized antibody heavy chain variable region 5E5RHA
QVQLVQSGAEVKKTGSSVKVSCKASGYTFTDHAIHWVRQAPGQALEWMGHFSPGNTDIKYNDKFKGRVTITRDRSMSTAYMELSSLRSEDTAMYYCATSTFFFDYWGQGTMVTVSS

SEQ ID NO: 16360 - protein, 116 aa, Artificial Sequence
  Description of Artificial Sequence: Synthetic polypeptide
  Synthetic sequence: Humanized antibody heavy chain variable region 5E5RHA2
QVQLVQSGAEVKKTGSSVKVSCKASGYTFTDHAIHWVRQAPGQALEWIGHFSPGNTDIKYNDKFKGRATLTVDRSMSTAYMELSSLRSEDTAMYYCKTSTFFFDYWGQGTMVTVSS

SEQ ID NO: 16361 - protein, 116 aa, Artificial Sequence
  Description of Artificial Sequence: Synthetic polypeptide
  Synthetic sequence: Humanized antibody heavy chain variable region 5E5RHA3
QVQLVQSGAEVKKTGSSVKVSCKASGYTFTDHAIHWVRQAPGQALEWMGHFSPGNTDIKYNDKFKGRATLTVDRSMSTAYMELSSLRSEDTAMYYCKTSTFFFDYWGQGTMVTVSS

SEQ ID NO: 16362 - protein, 116 aa, Artificial Sequence
  Description of Artificial Sequence: Synthetic polypeptide
  Synthetic sequence: Humanized antibody heavy chain variable region 5E5RHA4
QVQLVQSGAEVKKTGSSVKVSCKASGYTFTDHAIHWVRQAPGQALEWIGHFSPGNTDIKYNDKFKGRVTLTVDRSMSTAYMELSSLRSEDTAMYYCKTSTFFFDYWGQGTMVTVSS

SEQ ID NO: 16363 - protein, 116 aa, Artificial Sequence
  Description of Artificial Sequence: Synthetic polypeptide
  Synthetic sequence: Humanized antibody heavy chain variable region 5E5RHA5
QVQLVQSGAEVKKTGSSVKVSCKASGYTFTDHAIHWVRQAPGQALEWIGHFSPGNTDIKYNDKFKGRATITVDRSMSTAYMELSSLRSEDTAMYYCKTSTFFFDYWGQGTMVTVSS

SEQ ID NO: 16364 - protein, 116 aa, Artificial Sequence
  Description of Artificial Sequence: Synthetic polypeptide
  Synthetic sequence: Humanized antibody heavy chain variable region 5E5RHA6
QVQLVQSGAEVKKTGSSVKVSCKASGYTFTDHAIHWVRQAPGQALEWIGHFSPGNTDIKYNDKFKGRATLTRDRSMSTAYMELSSLRSEDTAMYYCKTSTFFFDYWGQGTMVTVSS

SEQ ID NO: 16365 - protein, 116 aa, Artificial Sequence
  Description of Artificial Sequence: Synthetic polypeptide
  Synthetic sequence: Humanized antibody heavy chain variable region 5E5RHA7
QVQLVQSGAEVKKTGSSVKVSCKASGYTFTDHAIHWVRQAPGQALEWIGHFSPGNTDIKYNDKFKGRATLTVDRSMSTAYMELSSLRSEDTAMYYCATSTFFFDYWGQGTMVTVSS

SEQ ID NO: 16366 - protein, 116 aa, Artificial Sequence
  Description of Artificial Sequence: Synthetic polypeptide
  Synthetic sequence: Humanized antibody heavy chain variable region 5E5RHA8
QVQLVQSGAEVKKTGSSVKVSCKASGYTFTDHAIHWVRQAPGQALEWMGHFSPGNTDIKYNDKFKGRVTLTVDRSMSTAYMELSSLRSEDTAMYYCKTSTFFFDYWGQGTMVTVSS

SEQ ID NO: 16367 - protein, 116 aa, Artificial Sequence
  Description of Artificial Sequence: Synthetic polypeptide
  Synthetic sequence: Humanized antibody heavy chain variable region 5E5RHB
EVQLVQSGAEVKKPGESLKISCKISGYIFTDHAIHWVRQMPGKGLEWMGHFSPGNTDIKYNDKFKGQVTFSVDRSINTAYLQWSSLKASDTAIYFCARSTFFFDYWGQGTRVTVSS

SEQ ID NO: 16368 - protein, 116 aa, Artificial Sequence
  Description of Artificial Sequence: Synthetic polypeptide
  Synthetic sequence: Humanized antibody heavy chain variable region 5E5RHB2
EVQLVQSGAEVKKPGESLKISCKISGYTFTDHAIHWVRQMPGKGLEWIGHFSPGNTDIKYNDKFKGQATLSVDRSINTAYLQWSSLKASDTAIYFCKTSTFFFDYWGQGTRVTVSS

SEQ ID NO: 16369 - protein, 116 aa, Artificial Sequence
  Description of Artificial Sequence: Synthetic polypeptide
  Humanized antibody heavy chain variable region 5E5RHB3
EVQLVQSGAEVKKPGESLKISCKISGYIFTDHAIHWVRQMPGKGLEWIGHFSPGNTDIKYNDKFKGQATLSVDRSINTAYLQWSSLKASDTAIYFCKTSTFFFDYWGQGTRVTVSS

SEQ ID NO: 16370 - protein, 116 aa, Artificial Sequence
  Description of Artificial Sequence: Synthetic polypeptide
  Synthetic sequence: Humanized antibody heavy chain variable region 5E5RHB4
EVQLVQSGAEVKKPGESLKISCKISGYTFTDHAIHWVRQMPGKGLEWMGHFSPGNTDIKYNDKFKGQATLSVDRSINTAYLQWSSLKASDTAIYFCKTSTFFFDYWGQGTRVTVSS

SEQ ID NO: 16371 - protein, 116 aa, Artificial Sequence
  Description of Artificial Sequence: Synthetic polypeptide
  Synthetic sequence: Humanized antibody heavy chain variable region 5E5RHB5
EVQLVQSGAEVKKPGESLKISCKISGYTFTDHAIHWVRQMPGKGLEWIGHFSPGNTDIKYNDKFKGQVTLSVDRSINTAYLQWSSLKASDTAIYFCKTSTFFFDYWGQGTRVTVSS

SEQ ID NO: 16372 - protein, 116 aa, Artificial Sequence
  Description of Artificial Sequence: Synthetic polypeptide
  Synthetic sequence: Humanized antibody heavy chain variable region 5E5RHB6
EVQLVQSGAEVKKPGESLKISCKISGYTFTDHAIHWVRQMPGKGLEWIGHFSPGNTDIKYNDKFKGQATFSVDRSINTAYLQWSSLKASDTAIYFCKTSTFFFDYWGQGTRVTVSS

SEQ ID NO: 16373 - protein, 116 aa, Artificial Sequence
  Description of Artificial Sequence: Synthetic polypeptide
  Synthetic sequence: Humanized antibody heavy chain variable region 5E5RHB7
EVQLVQSGAEVKKPGESLKISCKISGYTFTDHAIHWVRQMPGKGLEWIGHFSPGNTDIKYNDKFKGQATLSVDRSINTAYLQWSSLKASDTAIYFCATSTFFFDYWGQGTRVTVSS

SEQ ID NO: 16374 - protein, 116 aa, Artificial Sequence
  Description of Artificial Sequence: Synthetic polypeptide
  Synthetic sequence: Humanized antibody heavy chain variable region 5E5RHB8
EVQLVQSGAEVKKPGESLKISCKISGYTFTDHAIHWVRQMPGKGLEWIGHFSPGNTDIKYNDKFKGQATLSVDRSINTAYLQWSSLKASDTAIYFCKRSTFFFDYWGQGTRVTVSS

SEQ ID NO: 16375 - protein, 116 aa, Artificial Sequence
  Description of Artificial Sequence: Synthetic polypeptide
  Synthetic sequence: Humanized antibody heavy chain variable region 5E5RHB9
EVQLVQSGAEVKKPGESLKISCKISGYIFTDHAIHWVRQMPGKGLEWMGHFSPGNTDIKYNDKFKGQATLSVDRSINTAYLQWSSLKASDTAIYFCKTSTFFFDYWGQGTRVTVSS

SEQ ID NO: 16376 - protein, 116 aa, Artificial Sequence
  Description of Artificial Sequence: Synthetic polypeptide
  Synthetic sequence: Humanized antibody heavy chain variable region 5E5RHB10
EVQLVQSGAEVKKPGESLKISCKISGYIFTDHAIHWVRQMPGKGLEWMGHFSPGNTDIKYNDKFKGQVTLSVDRSINTAYLQWSSLKASDTAIYFCKTSTFFFDYWGQGTRVTVSS

SEQ ID NO: 16377 - protein, 116 aa, Artificial Sequence
  Description of Artificial Sequence: Synthetic polypeptide
  Synthetic sequence: Humanized antibody heavy chain variable region 5E5RHC
EVQLVESGAEVKKPGASVEVSCQASGYTFTDHAIHWVRQAPGQGLEWMGHFSPGNTDIKYNDKFKGRVTMTRDTSINTAYMELRRLRSDDTAVYYCATSTFFFDYWGQGTMVTVSS

SEQ ID NO: 16378 - protein, 116 aa, Artificial Sequence
  Description of Artificial Sequence: Synthetic polypeptide
  Synthetic sequence: Humanized antibody heavy chain variable region 5E5RHC2
EVQLVESGAEVKKPGASVEVSCQASGYTFTDHAIHWVRQAPGQGLEWIGHFSPGNTDIKYNDKFKGRATLTVDRSINTAYMELRRLRSDDTAVYYCKTSTFFFDYWGQGTMVTVSS

SEQ ID NO: 16379 - protein, 116 aa, Artificial Sequence
  Description of Artificial Sequence: Synthetic polypeptide
  Synthetic sequence: Humanized antibody heavy chain variable region 5E5RHC3
EVQLVESGAEVKKPGASVEVSCQASGYTFTDHAIHWVRQAPGQGLEWMGHFSPGNTDIKYNDKFKGRATLTVDRSINTAYMELRRLRSDDTAVYYCKTSTFFFDYWGQGTMVTVSS

SEQ ID NO: 16380 - protein, 116 aa, Artificial Sequence
  Description of Artificial Sequence: Synthetic polypeptide
  Synthetic sequence: Humanized antibody heavy chain variable region 5E5RHC4
EVQLVESGAEVKKPGASVEVSCQASGYTFTDHAIHWVRQAPGQGLEWIGHFSPGNTDIKYNDKFKGRVTLTVDRSINTAYMELRRLRSDDTAVYYCKTSTFFFDYWGQGTMVTVSS

SEQ ID NO: 16381 - protein, 116 aa, Artificial Sequence
  Description of Artificial Sequence: Synthetic polypeptide
  Synthetic sequence: Humanized antibody heavy chain variable region 5E5RHC5
EVQLVESGAEVKKPGASVEVSCQASGYTFTDHAIHWVRQAPGQGLEWIGHFSPGNTDIKYNDKFKGRATMTVDRSINTAYMELRRLRSDDTAVYYCKTSTFFFDYWGQGTMVTVSS

SEQ ID NO: 16382 - protein, 116 aa, Artificial Sequence
  Description of Artificial Sequence: Synthetic polypeptide
  Synthetic sequence: Humanized antibody heavy chain variable region 5E5RHC6
EVQLVESGAEVKKPGASVEVSCQASGYTFTDHAIHWVRQAPGQGLEWIGHFSPGNTDIKYNDKFKGRATLTRDRSINTAYMELRRLRSDDTAVYYCKTSTFFFDYWGQGTMVTVSS

SEQ ID NO: 16383 - protein, 116 aa, Artificial Sequence
  Description of Artificial Sequence: Synthetic polypeptide
  Synthetic sequence: Humanized antibody heavy chain variable region 5E5RHC7
EVQLVESGAEVKKPGASVEVSCQASGYTFTDHAIHWVRQAPGQGLEWIGHFSPGNTDIKYNDKFKGRATLTVDTSINTAYMELRRLRSDDTAVYYCKTSTFFFDYWGQGTMVTVSS

SEQ ID NO: 16384 - protein, 116 aa, Artificial Sequence
  Description of Artificial Sequence: Synthetic polypeptide
  Synthetic sequence: Humanized antibody heavy chain variable region 5E5RHC8
EVQLVESGAEVKKPGASVEVSCQASGYTFTDHAIHWVRQAPGQGLEWIGHFSPGNTDIKYNDKFKGRATLTVDRSINTAYMELRRLRSDDTAVYYCATSTFFFDYWGQGTMVTVSS

SEQ ID NO: 16385 - protein, 116 aa, Artificial Sequence
  Description of Artificial Sequence: Synthetic polypeptide
  Synthetic sequence: Humanized antibody heavy chain variable region 5E5RHC9
EVQLVESGAEVKKPGASVEVSCQASGYTFTDHAIHWVRQAPGQGLEWMGHFSPGNTDIKYNDKFKGRVTMTVDRSINTAYMELRRLRSDDTAVYYCKTSTFFFDYWGQGTMVTVSS

SEQ ID NO: 16386 - protein, 116 aa, Artificial Sequence
  Description of Artificial Sequence: Synthetic polypeptide
  Synthetic sequence: Humanized antibody heavy chain variable region 5E5RHC9 + V67A
EVQLVESGAEVKKPGASVEVSCQASGYTFTDHAIHWVRQAPGQGLEWMGHFSPGNTDIKYNDKFKGRATMTVDRSINTAYMELRRLRSDDTAVYYCKTSTFFFDYWGQGTMVTVSS

SEQ ID NO: 16387 - protein, 123 aa, Artificial Sequence
  Description of Artificial Sequence: Synthetic polypeptide
  antibody
EIQLVQSGPELKQPGETVRISCKASGYTFTNYGMNWVKQAPGKGLKWMGWINTYTGEPTYAADFKRRFTFSLETSASTAYLQISNLKNDDTATYFCAKYPHYYGSSHWYFDVWGAGTTVTVSS

SEQ ID NO: 16388 - protein, 123 aa, Artificial Sequence [sequence omitted]

SEQ ID NO: 16389 - protein, 122 aa, Artificial Sequence
  Description of Artificial Sequence: Synthetic polypeptide
  Synthetic VH sequence of 1P2D10.1
QVQLQQPGAELVKPGASVKLSCEASGYTFTSYWMHWVKQRPGQGLEWIGEINPYNGRPNYNEKFKNKATLTADKTSNTAYMQLSSLTSEDSAVYYCTRPSYYDYDGAWFAYWGQGTLVTVSA

SEQ ID NO: 16390 - protein, 117 aa, Artificial Sequence
  Description of Artificial Sequence: Synthetic polypeptide
  Synthetic VH sequence of 1P5B10.2
QVQLKQSGPSLVQPSQSLSITCTVSGFSLTSYGVHWFRQSPGKGLEWLGVIWRGGNTDYNAAFMSRLSITKDNSKSQVFFKMNSLQPDDTAIYYCVKNYRFGGSAYWGQGTLVTVSA

SEQ ID NO: 16391 - protein, 117 aa, Artificial Sequence
  Description of Artificial Sequence: Synthetic polypeptide
  Synthetic VH sequence of M61-C02
EVQLLESGGGLVQPGGSLRLSCAASGFTFSPYAMTWVRQAPGKGLEWVSWIVSSGGYTVYADSVKGRFTISRDNSKNTLYLQMNSLRAEDTAVYYCARVDYGAFDIWGQGTMVTVSS

SEQ ID NO: 16392 - protein, 118 aa, Artificial Sequence
  Description of Artificial Sequence: Synthetic polypeptide
  Synthetic VH sequence of M61-C03
EVQLLESGGGLVQPGGSLRLSCAASGFTFSHYKMDWVRQAPGKGLEWVSYIGPSGGVTYYADSVKGRFTISRDNSKNTLYLQMNSLRAEDTAVYYCARFSGYNSLDYWGQGTLVTVSS

SEQ ID NO: 16393 - protein, 122 aa, Artificial Sequence
  Description of Artificial Sequence: Synthetic polypeptide
  Synthetic VH sequence of M65-A11
EVQLLESGGGLVQPGGSLRLSCAASGFTFSGYYMSWVRQAPGKGLEWVSGIYSSGGTTHYADSVKGRFTISRDNSKNTLYLQMNSLRAEDTAVYYCAKGSGYYHYYYGMDVWGQGTTVTVSS

SEQ ID NO: 16394 - protein, 122 aa, Artificial Sequence
  Description of Artificial Sequence: Synthetic polypeptide
  Synthetic VH sequence of M66-H09
EVQLLESGGGLVQPGGSLRLSCAASGFTFSEYTMSWVRQAPGKGLEWVSRIYSSGGHTEYADSVKGRFTISRDNSKNTLYLQMNSLRAEDTAVYYCAKGSGYYHYYYGMDVWGQGTTVTVSS

SEQ ID NO: 16395 - protein, 152 aa, Mus musculus
  heavy chain variable region (1A7)
MAVLGLLFCLVTFPSCVLSQVQVKESGPFLVPPSQSLSITCTVSGFSLTTYGVSWIRQPPGKGLEWLGAIWGDGTTNYHSALISRLSISKDNSKSQVFLKLNSLQTDDTATYYCAKLGNYDALDYWGQGTSVTVSSAKTTPPPVYPLVPGSL

SEQ ID NO: 16396 - protein, 118 aa, Artificial Sequence
  Description of Artificial Sequence: Synthetic polypeptide
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 16397 - protein, 121 aa, Artificial Sequence
  Description of Artificial Sequence: Synthetic polypeptide
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 16398 - protein, 116 aa, Mus musculus; identical to SEQ ID NO: 10475

SEQ ID NO: 16399 - protein, 116 aa, Mus musculus; identical to SEQ ID NO: 10476

SEQ ID NO: 16400 - protein, 116 aa, Mus musculus; identical to SEQ ID NO: 11231

SEQ ID NO: 16401 - protein, 120 aa, Artificial Sequence
  Description of Artificial Sequence: Synthetic polypeptide
QVQLVESGAEVKKPGASVKVSCKASGYTFTSYAIHWVRQAPGQRLEWMGWINAGNGYRKYSQKFQGRVTVTRDTSASTAYMELSSLRSEDTAVYYCARFEGGMVTAMDFWGQGTLVTVSS

SEQ ID NO: 16402 - protein, 119 aa, Artificial Sequence
  Description of Artificial Sequence: Synthetic polypeptide
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 16403 - protein, 118 aa, Artificial Sequence
  Description of Artificial Sequence: Synthetic polypeptide
  Humanised KM666 VH sequence
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSS

SEQ ID NO: 16404 - protein, 120 aa, Artificial Sequence
  Description of Artificial Sequence: Synthetic polypeptide
EVQLLESGAEVKKPGASVKVSCKASGYTFTSYAIHWVRQAPGQRLEWMGWINAGNGYRKYSQKFQGRVTVTRDTSASTAYMELSSLRSEDTAVYYCARFEGGMVTAMDYWGQGTLVTVSS

SEQ ID NO: 16405 - protein, 119 aa, Artificial Sequence
  Description of Artificial Sequence: Synthetic polypeptide
QVQLVESGAEVKKPGASVKMSCRASGYTFTRYYMHWVRQAPGQGLEWMGIINPSAGSTSYAQKFQDRVTMTRDTSRSTVYMELSSLRSEDTAVYYCARRVVVGGPFDFWGQGTLVTVSS

SEQ ID NO: 16406 - protein, 119 aa, Artificial Sequence
  Description of Artificial Sequence: Synthetic polypeptide
QVQLVESGAEVKKPGASVRVSCKASGYRFISYYMHWVRQAPGQGLEWMGIINPSGGSTSYAQKFQGRVTMTRDTSTSTIYMELSSLRSEDTAVYYCARRNIVTGPFDYWGQGTLVTVSS

SEQ ID NO: 16407 - protein, 119 aa, Artificial Sequence
  Description of Artificial Sequence: Synthetic polypeptide
QVQLVESGAEVKKPGASVKVSCKASGYTFARYYMHWVRQAPGQGPEWMGIINPSGGSTSYAQKFQGRVTVTRDTSTSTVYMELSSLRSEDTAVYYCARRVVLGGPFDYWGQGTLVTVSS

SEQ ID NO: 16408 - protein, 119 aa, Artificial Sequence
  Description of Artificial Sequence: Synthetic polypeptide
EVQLLESGAEVKKPGASVKVSCKASGYTFTRYYMHWVRQAPGQGLEWMGIINPSSGSTSYAQKFQGRVTMTRDTSTSTVYMELSSLRSEDMAVYYCARRVVVGGPFDYWGQGTLVTVSS

SEQ ID NO: 16409 - protein, 120 aa, Artificial Sequence
  Description of Artificial Sequence: Synthetic polypeptide
EVQLLESGAEVKKPGASVKVSCKASGYIFSRYAIHWVRQAPGQGLEWMGWINPFNGFTKYSQKFQGRVALTRDRSATTGYMELSSLTSEDTAVYYCARLESNKFYAFDIWGQGTMVTVSS

SEQ ID NO: 16410 - protein, 120 aa, Artificial Sequence
  Description of Artificial Sequence: Synthetic polypeptide
QVQLLESGAEVKKPGASVKVSCKASGYTFTSYAMHWVRQAPGQRLEWMGWINAGNGNTIYSQKFQARVTITRDTSASTAYMELSSLRSEDTAVYYCARWVGGVASYFDYWGQGTLVTVSS

SEQ ID NO: 16411 - protein, 121 aa, Artificial Sequence
  Description of Artificial Sequence: Synthetic polypeptide
QVQLLESGAEVKKPGASVKVSCEASGYTFTSSDINWVRQATGQGLEWMGWMNPNSGNTGYAQKFQGRVTMTRNTSISTAYMELSSLRSEDTAVYYCARERPRRRGGGFDIWGQGTMVTVSS

SEQ ID NO: 16412 - protein, 121 aa, Artificial Sequence
  Description of Artificial Sequence: Synthetic polypeptide
QVQLQQSGAEVKKPGASVKVSCEASGYTFTSSDINWVRQATGQGLEWMGWMNPKSGNTGYAQKFQGRVTMTRNTSISTAYMELSSLRSEDTAVYYCARERPRRRGGGFDIWGQGTMVTVSS

SEQ ID NO: 16413 - protein, 119 aa, Artificial Sequence
  Description of Artificial Sequence: Synthetic polypeptide
QVQLVESGAEVKKPGASVKVSCKASGYTFTNYYMHWVRQAPGQGLEWMGIINPSRGSTSYAQKFQGRVTMTRDTSTSTVYMELSSLRSEDTAVYYCARRQMATGPFDYWGQGTLVTVSS

SEQ ID NO: 16414 - protein, 120 aa, Homo sapiens
  heavy chain variable region
QVQLVESGGGVVQPGRSLRLSCAASGFTFSNFGMHWVRQAPGKGLEWVAYISSGGSSINYADTVKGRFTISRDNSKNTLYLQMNSLRAEDTAVYYCTRGGTGTRSLYYFDYWGQGTTVTV

SEQ ID NO: 16415 - protein, 120 aa, Homo sapiens
  heavy chain variable region
DVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIV

SEQ ID NO: 16416 - protein, 122 aa, Homo sapiens
  heavy chain variable region
QVQLVESGGGVVQPGRSLRLSCAASGFTFSNFGMHWVRQAPGKGLEWVAYISSGGSSINYADTVKGRFTISRDNSKNTLYLQMNSLRAEDTAVYYCTRGGTGTRSLYYFDYWGQGTTVTVSS

SEQ ID NO: 16417 - protein, 122 aa, Homo sapiens
  heavy chain variable region
DVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVSS

SEQ ID NO: 16418 - protein, 126 aa, Artificial Sequence
  Description of Artificial Sequence: Synthetic polypeptide
  Heavy chain variable region of mature IgM protein PolrecCHOIgM/GD3
QVQLVQSGAEMKKPGASVKVSCKASGYTFSSFAMHWVRQAPGQRLEWMGWINAGNGNTKYSQKFQGRLTITRDTSASTAYMDLSSLRSEDTAVYYCARNLNYYDILTGLDAFDIWGQGTMVTVSSG

SEQ ID NO: 16419 - protein, 118 aa, Artificial Sequence
  Description of Artificial Sequence: Synthetic polypeptide
  BW2121 heavy chain variable region
QVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSS

SEQ ID NO: 16420 - protein, 121 aa, Artificial Sequence
  Description of Artificial Sequence: Synthetic polypeptide
  MB3.6 heavy chain variable region
EVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSS

SEQ ID NO: 16421 - protein, 137 aa, Artificial Sequence
  Description of Artificial Sequence: Synthetic polypeptide
  chimeic human antibody
MGWSWIFLFLLSGTAGVLSEVQLQQSGPELVKPGASVKISCKASGYTFTDYNMDWVKQSHGKSLEWIGYIYPNNGGTGYNQKFKSKATLTVDKSSSTAYMELHSLTSEDSAVYYCARAGRYYYAWDWGQGTLVTVSA

SEQ ID NO: 16422 - protein, 144 aa, Artificial Sequence
  Description of Artificial Sequence: Synthetic polypeptide
  chimeic human antibody
MGWSWIFLFLLSGTAGVLSQVQLQESGPGLVRPSQTLSLTCTVSGFTFSDYNMDWVRQPPGRGLEWIGYIYPNNGGTGYNQKFKSRVTMLVDTSKNQFSLRLSSVTAADTAVYYCARYGHYYGYMFAYWGQGTTVTVSSASTKG

SEQ ID NO: 16423 - protein, 137 aa, Homo sapiens; identical to SEQ ID NO: 5360

SEQ ID NO: 16424 - protein, 137 aa, Homo sapiens; identical to SEQ ID NO: 5361

SEQ ID NO: 16425 - protein, 119 aa, Artificial Sequence; identical to SEQ ID NO: 12568
  Description of Artificial Sequence: Synthetic polypeptide
  immunoglobulin heavy chain

SEQ ID NO: 16426 - protein, 118 aa, Artificial Sequence; identical to SEQ ID NO: 11237
  Description of Artificial Sequence: Synthetic polypeptide
  immunoglobulin heavy chain

SEQ ID NO: 16427 - protein, 125 aa, Artificial Sequence [sequence omitted]

SEQ ID NO: 16428 - protein, 130 aa, Artificial Sequence; identical to SEQ ID NO: 12410
  Description of Artificial Sequence: Synthetic polypeptide
  immunoglobulin heavy chain

SEQ ID NO: 16429 - protein, 119 aa, Artificial Sequence
  Description of Artificial Sequence: Synthetic polypeptide
  immunoglobulin heavy chain
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTWVTVSS

SEQ ID NO: 16430 - protein, 117 aa, Artificial Sequence; identical to SEQ ID NO: 10732
  Description of Artificial Sequence: Synthetic polypeptide
  immunoglobulin heavy chain

SEQ ID NO: 16431 - protein, 106 aa, Artificial Sequence
  Description of Artificial Sequence: Synthetic polypeptide
GLVKPSQTLSLTCAISGDSVSSKSVAWNWIRQSPLRGLEWLGRTYYRSKWYNEYAVSVKSRITINPDTSKNQFSLHLNSVTPEDTAVYYCARNFDYWGQGTLVTVS

SEQ ID NO: 16432 - protein, 137 aa, Mus musculus
  heavy chain variable region
MKLWLNWIFLVTLLNGFQCEVKLVESGGGLVLPGDSLRLSCATSEFTFTDYYMTWVRQPPRKALEWLGFIRNRANGYTTEYNPSVKGRFTISRDNSQILYLQMNTLRTEDSATYYCARVSNWAFDYWGQTTLTVSSA

SEQ ID NO: 16433 - protein, 119 aa, Artificial Sequence
  Description of Artificial Sequence: Synthetic polypeptide
  HCVR
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSS

SEQ ID NO: 16434 - protein, 122 aa, Artificial Sequence
  Description of Artificial Sequence: Synthetic polypeptide
  Synthetic consensus sequence
  MOD_RES (1)..(1): Glu or Gln
  MOD_RES (6)..(6): Glu or Gln
  MOD_RES (16)..(16): Arg or Gly
  MOD_RES (49)..(49): Ser or Ala
  MOD_RES (54)..(54): Asp or Asn
  MOD_RES (58)..(58): Val, Arg, Thr, Ile, Met, Ser, Asn or Leu
  MOD_RES (102)..(102): Ala, Phe or Tyr
  MOD_RES (103)..(103): Tyr, Asn, Lys, Phe, Met or Ser
  MOD_RES (106)..(106): Glu, Val, Trp, Leu, Gln or Asn
  MOD_RES (107)..(107): Glu or Asp
XVQLVXSGGGLVQPGXSLRLSCAASGFTFDDYAMHWVRQAPGKGLEWVXGISWXSGSXGYADSVKGRFTISRDNAKNSLYLQMNSLRAEDTALYYCARDLGXXQWXXGFDYWGQGTLVTVSS

SEQ ID NO: 16435 - protein, 119 aa, Mus musculus
QVQLQQSGAELVRPGTSVKMSCKAAGYTFTNYWIVWVKQRPGHGLEWIGDIYPGSGHTNYNEKFKGKATLTADTSSSTANMQLSSLTSEDSAIYYCVRPINYDGSYDYWGQGTTLTVSS

SEQ ID NO: 16436 - protein, 465 aa, Mus musculus; identical to SEQ ID NO: 10478

SEQ ID NO: 16437 - protein, 249 aa, Artificial Sequence; identical to SEQ ID NO: 11972
  Description of Artificial Sequence: Synthetic polypeptide
  Synthetic construct

SEQ ID NO: 16438 - protein, 249 aa, Artificial Sequence; identical to SEQ ID NO: 11971
  Description of Artificial Sequence: Synthetic polypeptide
  Synthetic construct

SEQ ID NO: 16439 - protein, 458 aa, Artificial Sequence; identical to SEQ ID NO: 15552
  Description of Artificial Sequence: Synthetic polypeptide
  73R009 Heavy chain amino acid sequence with predicted signal sequence

SEQ ID NO: 16440 - protein, 458 aa, Artificial Sequence; identical to SEQ ID NO: 15553
  Description of Artificial Sequence: Synthetic polypeptide
  73R009 (13A variant) Heavy chain amino acid sequence with predicted signal sequence

SEQ ID NO: 16441 - protein, 439 aa, Artificial Sequence; identical to SEQ ID NO: 15556
  Description of Artificial Sequence: Synthetic polypeptide
  73R009 Heavy chain amino acid sequence without predicted signal  sequence

SEQ ID NO: 16442 - protein, 439 aa, Artificial Sequence; identical to SEQ ID NO: 15554
  Description of Artificial Sequence: Synthetic polypeptide
  73R009 (13A variant) Heavy chain amino acid sequence without predicted signal sequence

SEQ ID NO: 16443 - protein, 439 aa, Artificial Sequence; identical to SEQ ID NO: 15555
  Description of Artificial Sequence: Synthetic polypeptide
  73R009 (13B variant) Heavy chain amino acid sequence without  signal sequence

SEQ ID NO: 16444 - protein, 118 aa, Artificial Sequence
  Description of Artificial Sequence: Synthetic polypeptide
  VH domain
  MOD_RES (64)..(64): Gln, Thr, Ser or Asn
EVQLLESGGGLVQPGGSLRLSCAASGFTFSYYYMQWVRQAPGKGLEWVSYIGSSGGVTNYADSXKGRFTISRDNSKNTLYLQMNSLRAEDTAVYYCARVGLGDAFDIWGQGTMVTVSS

SEQ ID NO: 16445 - protein, 118 aa, Artificial Sequence
  Description of Artificial Sequence: Synthetic polypeptide
  VH domain
  MOD_RES (31)..(31): Ser, Ala or Gly
EVQLLESGGGLVQPGGSLRLSCAASGFTFSXYYMQWVRQAPGKGLEWVSYIGSSGGVTNYADSVKGRFTISRDNSKNTLYLQMNSLRAEDTAVYYCARVGLGDAFDIWGQGTMVTVSS

SEQ ID NO: 16446 - protein, 232 aa, Homo sapiens
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16447 - protein, 12 aa, Homo sapiens
ERKCCVECPPCP

SEQ ID NO: 16448 - protein, 106 aa, Homo sapiens; identical to SEQ ID NO: 3203
  Human Ig kappa constant region (1)..(106)

SEQ ID NO: 16449 - protein, 331 aa, Homo sapiens
  Human IGHG1 constant region
SASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16450 - protein, 40 aa, Homo sapiens
GGGSIKQIEDKIEEILSKIYHIENEIARIKKLIGERGHDI

SEQ ID NO: 16451 - protein, 214 aa, Artificial Sequence
  Description of Artificial Sequence: Synthetic polypeptide
DIQMTQSPSSLSASTGDRVTITCRASQGISSYLAWYQQKPGKAPKLLIYARSTRQSGVPSRFSGSGSGTDFTLTISSLQPEDFATYYCQQYWRWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16452 - protein, 214 aa, Artificial Sequence
  Description of Artificial Sequence: Synthetic polypeptide
DIQMTQSPSSLSASTGDRVTITCRASQGISSYLAWYQQKPGKAPKLLIYAKSTLQSGVPSRFSGSGSGTDFTLTISSLQPEDFATYYCQQYWTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16453 - protein, 214 aa, Artificial Sequence
  Description of Artificial Sequence: Synthetic polypeptide
DIQMTQSPSSLSASTGDRVTITCRASQGISSYLAWYQQKPGKAPKLLIYAASTLQSGVPSRFSGSGSGTDFTLTISSLQPEDFATYYCQQYFTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16454 - protein, 214 aa, Artificial Sequence
  Description of Artificial Sequence: Synthetic polypeptide
DIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16455 - protein, 214 aa, Artificial Sequence
  Description of Artificial Sequence: Synthetic polypeptide
DIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16456 - protein, 214 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16457 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 16458 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 16459 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVIGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 16460 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDVPGDQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 16461 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDWPGNQWVFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 16462 - protein, 107 aa, Mus musculus
DIQMNQSPSSLSASLGDTITITCHASQNINVWLSWYQQKPGNIPKLLIYKASNLHTGVPSRFSGSGSGTGFTLTISSLQPEDIATYYCQQGQSYPRTFGGGTKLEIR

SEQ ID NO: 16463 - protein, 219 aa, Artificial Sequence
  Description of Artificial Sequence: Synthetic polypeptide
DVVVTQTPLSLPVSFGDQVSISCRSSQSLANSYGNTYLSWYLHKPGQSPQLLIYGISNRFSGVPDRFSGSGSGTDFTLKISTIKPEDLGMYYCLQGTHQPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16464 - protein, 214 aa, Artificial Sequence
  Description of Artificial Sequence: Synthetic polypeptide
  antibody
DIQMTQSPSSLSASVGDRVTITCRASKTISKYLAWYQQKPGKAPKLLIYSGSTLQSGVPSRFSGSGSGTDFTLTISSLQPEDFATYYCQQHNEYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16465 - protein, 219 aa, Artificial Sequence
  Description of Artificial Sequence: Synthetic polypeptide
  CD19 (8B8) parental light chain
DAVMTQTPLSLPVSLGDQASISCRSSQSLENSNGNTYLNWYLQKPGQSPQLLIYRVSKRFSGVLDRFSGSGSGTDFTLKISRVEAEDLGVYFCLQLTHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16466 - protein, 219 aa, Artificial Sequence
  Description of Artificial Sequence: Synthetic polypeptide
  anti-CD19(8B8-018) light chain
DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16467 - protein, 219 aa, Artificial Sequence
  Description of Artificial Sequence: Synthetic polypeptide
  CD19 (8B8-2B03)  light chain
  MOD_RES (107)..(107): Any naturally occurring amino acid
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHVPYTFGQGXKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16468 - protein, 219 aa, Artificial Sequence
  Description of Artificial Sequence: Synthetic polypeptide
  CD19 (8B8-2B11)  light chain
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16469 - protein, 219 aa, Artificial Sequence
  Description of Artificial Sequence: Synthetic polypeptide
  CD19 (8B8-5A07)  light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQPGHYPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16470 - protein, 219 aa, Artificial Sequence
  Description of Artificial Sequence: Synthetic polypeptide
  CD19 (8B8-5B08) light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLDSYPNTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16471 - protein, 219 aa, Artificial Sequence
  Description of Artificial Sequence: Synthetic polypeptide
  CD19 (8B8-5D08)  light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHEPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16472 - protein, 219 aa, Artificial Sequence
  Description of Artificial Sequence: Synthetic polypeptide
  CD19 (8B8-5H09)  light chain
DIVMTQTPLSLSVTPGQPASISCKSSQSLESSTGNTYLNWYLQKPGQSPQLLIYRVSKRFSGVPDRFSGSGSGTDFTLKISRVEAEDVGVYYCLQLIDYPVTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16473 - protein, 219 aa, Artificial Sequence
  Description of Artificial Sequence: Synthetic polypeptide
  CD19 (8B8-7H07)  light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQATHIPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16474 - protein, 213 aa, Artificial Sequence; identical to SEQ ID NO: 7530
  Description of Artificial Sequence: Synthetic polypeptide
  full length light chain

SEQ ID NO: 16475 - protein, 213 aa, Artificial Sequence; identical to SEQ ID NO: 7947
  Description of Artificial Sequence: Synthetic polypeptide
  full length light chain

SEQ ID NO: 16476 - protein, 106 aa, Artificial Sequence
  Description of Artificial Sequence: Synthetic polypeptide
  CD3 single variable domain (clone OKT1) VL
DIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEIN

SEQ ID NO: 16477 - protein, 107 aa, Artificial Sequence [sequence omitted]

SEQ ID NO: 16478 - protein, 215 aa, Artificial Sequence
  Description of Artificial Sequence: Synthetic polypeptide
  Synthetic Light chain humanized CD3 binder CD3 CH2527 (VL_7-46(13)) polypeptide
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 16479 - protein, 218 aa, Artificial Sequence
  Description of Artificial Sequence: Synthetic polypeptide
  Light Chain VL CD33 (Myelotarg)
DIQLTQSPSTLSASVGDRVTITCRASESLDNYGIRFLTWFQQKPGKAPKLLMYAASNQGSGVPSRFSGSGSGTEFTLTISSLQPDDFATYYCQQTKEVPWSFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16480 - protein, 215 aa, Artificial Sequence
  Description of Artificial Sequence: Synthetic polypeptide
  CH1A1A light chain
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16481 - protein, 213 aa, Artificial Sequence
  Description of Artificial Sequence: Synthetic polypeptide
  anti-CEA(sm9b) light chain
ENVLTQSPSSMSVSVGDRVTIACSASSSVPYMHWLQQKPGKSPKLLIYSTSNLASGVPSRFSGSGSGTDYSLTISSVQPEDAATYYCQQRSSYPLTFGCGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16482 - protein, 218 aa, Artificial Sequence
  Description of Artificial Sequence: Synthetic polypeptide
  CEA (T84.66-LCHA)  light chain
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16483 - protein, 218 aa, Artificial Sequence
  Description of Artificial Sequence: Synthetic polypeptide
  CEA (T84.66)  light chain
DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16484 - protein, 236 aa, Homo sapiens
  MOD_RES (91)..(91): Ala or Thr
MDMRVPAQLLGLLLLWFPGSRCDIQMTQSPSSVSASVGDRVTITCRASQGINTWLAWYQQKPGKAPKLLIYAASSLKSGVPSRFSGSGSGXDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16485 - protein, 129 aa, Homo sapiens
MDMRVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 16486 - protein, 218 aa, Mus musculus
DIVLTQSPDSLAVSLGERATINCKSSESVDSYANSFMHWYQQKPGQPPKLLIYRASTRESGVPDRFSGSGSRTDFTLTISSLQAEDVAVYYCQQSKEDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16487 - protein, 218 aa, Mus musculus; identical to SEQ ID NO: 12636

SEQ ID NO: 16488 - protein, 218 aa, Mus musculus; identical to SEQ ID NO: 12637

SEQ ID NO: 16489 - protein, 218 aa, Mus musculus; identical to SEQ ID NO: 12638

SEQ ID NO: 16490 - protein, 236 aa, Homo sapiens
MDMRVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQSEDFATYYCQQANSFPITFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16491 - protein, 129 aa, Homo sapiens
MDMRVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 16492 - protein, 236 aa, Homo sapiens
MDMRVPAQLLGLLLLWFPGSRCDIQMTQSPSSVSASVGDRVIITCRASQGISSWLAWYQQKPGKAPKLLIYAASSLKSGVPSRFSGSGSGTDFTVTISSLQPEDFATYYCQQSNSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16493 - protein, 129 aa, Homo sapiens
MDMRVPAQLLGLLLLWFPGSRCDIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGQGTKVEIK

SEQ ID NO: 16494 - protein, 236 aa, Homo sapiens
METPAQLLFLLLLWLPDTTGEIVLTQSPGTLSLSPGERATLSCRASQSVSNNYLAWYQQKPGQAPRLLIFGASSRATGIPDRFSGSGSGTDFTLTISRLEPEDFAVYYCQQYDISPMYSFGQGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16495 - protein, 128 aa, Homo sapiens
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 16496 - protein, 215 aa, Artificial Sequence; identical to SEQ ID NO: 7839
  Description of Artificial Sequence: Synthetic polypeptide
  synthetic construct

SEQ ID NO: 16497 - protein, 213 aa, Homo Sapiens
QLTQSPSSLSASVGDRVTITCRASQGLSSALAWYRQKPGKAPKLLIYDASSLESGVPSRFSGSGSGTDFTLTISSLQPEDFATYYCQQFTSYPQITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16498 - protein, 214 aa, Homo Sapiens
DIQMTQSPSSVSASVGDRVTITCRASQGISNWLAWFQHKPGKAPKLLIYAASSLLSGVPSRFSGSGSGTDFTLTISSLQPEDFATYYCQQANSFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16499 - protein, 220 aa, Artificial Sequence; identical to SEQ ID NO: 12630
  Description of Artificial Sequence: Synthetic polypeptide
  Synthetic (amino acid sequence of light chain of antibody L3-11Y)

SEQ ID NO: 16500 - protein, 227 aa, Artificial Sequence; identical to SEQ ID NO: 10367
  Description of Artificial Sequence: Synthetic polypeptide
  synthetic construct

SEQ ID NO: 16501 - protein, 215 aa, Artificial Sequence
  Description of Artificial Sequence: Synthetic polypeptide
  synthetic constuct
ETTVTQSPALMAASPGEKVTITCSVSSSISSTNLHWYQQKSETSPKPWIYGTSNLASGVPVRFGGSGSGTSYSLTISSMEAEDAATYYCQQWSSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16502 - protein, 220 aa, Artificial Sequence; identical to SEQ ID NO: 7840
  Description of Artificial Sequence: Synthetic polypeptide

SEQ ID NO: 16503 - protein, 219 aa, Artificial Sequence
  Description of Artificial Sequence: Synthetic polypeptide
  sequence is synthesized
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16504 - protein, 214 aa, Artificial Sequence
  Description of Artificial Sequence: Synthetic polypeptide
  synthetic construct
EIQMTQSPASLSASVGETVTITCRASENIYSYLAWYQRKQGRSPQLLVYNAKPLAEGVPSRFSGSGSGTQFSLKINSLQPEDFGTYYCQHHYGTPFTFGSGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16505 - protein, 215 aa, Artificial Sequence
  Description of Artificial Sequence: Synthetic polypeptide
  Synthetic (light chain of an anti-c-Met antibody)
DIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGDC

SEQ ID NO: 16506 - protein, 218 aa, Artificial Sequence
  Description of Artificial Sequence: Synthetic polypeptide
  light chain sequence, anti-CSPG4 chimeric light chain (clone 9.2.27)
DIELTQSPASLAVSLGQRATISCRASESVDSYGNSFMHWYQQKPGQPPKLLIYLASNLESGVPARFSGSGSRTDFTLTIDPVEADDAATYYCQQNNEDPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16507 - protein, 216 aa, Mus musculus; identical to SEQ ID NO: 13811

SEQ ID NO: 16508 - protein, 221 aa, Mus musculus; identical to SEQ ID NO: 13812

SEQ ID NO: 16509 - protein, 220 aa, Mus musculus; identical to SEQ ID NO: 13813

SEQ ID NO: 16510 - protein, 220 aa, Mus musculus; identical to SEQ ID NO: 13817

SEQ ID NO: 16511 - protein, 220 aa, Artificial Sequence; identical to SEQ ID NO: 13815
  Description of Artificial Sequence: Synthetic polypeptide

SEQ ID NO: 16512 - protein, 216 aa, Artificial Sequence; identical to SEQ ID NO: 13860
  Description of Artificial Sequence: Synthetic polypeptide

SEQ ID NO: 16513 - protein, 214 aa, Artificial Sequence; identical to SEQ ID NO: 7572
  Description of Artificial Sequence: Synthetic polypeptide
  light chain sequence, anti- EGFR chimeric light chain (clone C225)

SEQ ID NO: 16514 - protein, 214 aa, Homo Sapiens; identical to SEQ ID NO: 7615

SEQ ID NO: 16515 - protein, 214 aa, Homo Sapiens
AIQLTQSPSSLSASVGDRVTITCRASQDISSALVWYQQKPGKAPKLLIYDASSLESGVPSRFSGSESGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16516 - protein, 213 aa, Artificial Sequence
  Description of Artificial Sequence: Synthetic polypeptide
  huEGFR-8 LC, full-Length Heavy/Light Chain
DIVLTQSPAFMSASPGEKVTMTCSASSSVSYMHWYQQKPDQSPKRWIYATSKLASGVPSRFSGSGSGTDYSLTISSMEAEDAATYYCQQWSSNPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16517 - protein, 213 aa, Artificial Sequence
  Description of Artificial Sequence: Synthetic polypeptide
  huML66LC, full-Length Heavy/Light Chain
DTVLTQSPSLAVSPGERATISCRASESVSTLMHWYQQKPGQQPKLLIYLASHRESGVPARFSGSGSGTDFTLTIDPMEAEDTATYYCQQSRNDPWTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16518 - protein, 219 aa, Artificial Sequence
  Description of Artificial Sequence: Synthetic polypeptide
DIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQITREVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16519 - protein, 107 aa, Artificial Sequence [sequence omitted]

SEQ ID NO: 16520 - protein, 214 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16521 - protein, 111 aa, Mus musculus
DIVLTQSPASLAVSLGQRATISCRASKSVSTSGYSYMHWYQQKPGQPPKLLIYLASNLESGVPARFSGSGSGTDFTLNIHPVEEEDAATYYCQHSRELPLTFGAGTKLELK

SEQ ID NO: 16522 - protein, 112 aa, Mus musculus; identical to SEQ ID NO: 7390

SEQ ID NO: 16523 - protein, 111 aa, Mus musculus
DIVLTQSPASLAVSLGQRATISCRVSESVDSYGNSFMHWYQQKPGQPPKLLIYRASNLESGIPDRFSGSVSRTDFTLTINPVEPDDVATYYCQQTNEDPPTFGGGTKLEIK

SEQ ID NO: 16524 - protein, 469 aa, Artificial Sequence
  Description of Artificial Sequence: Synthetic polypeptide
  chemically synthesized
MYRMQLLSCIALSLALVTNSQVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16525 - protein, 281 aa, Artificial Sequence
  Description of Artificial Sequence: Synthetic polypeptide
  chemically synthesized
MYRMQLLSCIALSLALVTNSQGQSGQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16526 - protein, 261 aa, Artificial Sequence; identical to SEQ ID NO: 12736
  Description of Artificial Sequence: Synthetic polypeptide
  chemically synthesized

SEQ ID NO: 16527 - protein, 214 aa, Artificial Sequence
  Description of Artificial Sequence: Synthetic polypeptide
  chemically synthesized
QILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16528 - protein, 223 aa, Artificial Sequence
  Description of Artificial Sequence: Synthetic polypeptide
  chemically synthesized
SDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16529 - protein, 220 aa, Artificial Sequence
  Description of Artificial Sequence: Synthetic polypeptide
  chemically synthesized
HGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16530 - protein, 238 aa, Artificial Sequence
  Description of Artificial Sequence: Synthetic polypeptide
MKLPVRLLVLMFWIPASSSDVLMTQIPLSLPVSLGDQASISCRSSQSIVHSNGNTYLEWYLQKPGQSPKSLIYKVSNRFSGVPDRFSGSGSGTDFTLKISRVEAEDLGVYYCFQGSYVPWTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16531 - protein, 239 aa, Artificial Sequence
  Description of Artificial Sequence: Synthetic polypeptide
MRCLAEFLGLLVLWIPGAIGDIVLTQTAPSVPVTPGESVSISCRSSKSLLHSNGNTYLYWFLQRPGQSPQLLIYRMSNLASGVPDRFSGSGSGTAFTLRISRVEAEDVGVYYCMQHLEYPFTFGSGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16532 - protein, 238 aa, Artificial Sequence
  Description of Artificial Sequence: Synthetic polypeptide
MKLPVRLLVLMFWIPASRSDVLMTQTPLSLPVSLGDQASISCRSSQSIVHSIGNTYLEWYLQKPGQSPKLLIYKVSNRFSGVPERFSGSGSGTDFTLKISRVEAEDLGVYYCFQGSHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16533 - protein, 238 aa, Artificial Sequence
  Description of Artificial Sequence: Synthetic polypeptide
MKLPVRLLVLMFWIPASSSDVLMTQIPLSLPVSLGDQASISCRSSQSIVHSNGNTYLEWYLQKPGQSPKLLIYKVSNRFSGVPDRFSGSGSGTDFTLKISRVEAEDLGVYYCFQGSYVPWTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16534 - protein, 234 aa, Artificial Sequence
  Description of Artificial Sequence: Synthetic polypeptide
MFSLALLLSLLLLCVSDSRAETTVTQSPASLSMAIGDKVTIRCITSTDIDDDMNWFQQKPGEPPKLLISEGNTLRPGVPSRFSGSGYGTDFIFTIENMLSEDVADYYCLQSDNLPYTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16535 - protein, 238 aa, Artificial Sequence
  Description of Artificial Sequence: Synthetic polypeptide
MKLPVRLLVLMFWIPASSSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSYVPWTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16536 - protein, 236 aa, Artificial Sequence
  Description of Artificial Sequence: Synthetic polypeptide
MDMRVPAHVFGFLLLWFPGTRCDIQMTQSPSSLSASLGERVSLTCRASQEISGYLSWLQQKPDGTIKRLIYAASTLDSGVPKRFSGSRSGSDYSLTIGSLESEDLADYYCLQYDSYPYTFGGGTKLEIKRADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16537 - protein, 107 aa, Artificial Sequence
  Description of Artificial Sequence: Synthetic polypeptide
RADAAPTVSIFPPSSEQLTSGGASVVCFLNNFYPRDINVKWKIDGSERQNGVLNSWTDQDSKDSTYSMSSTLTLTKDEYERHNSYTCEATHKTSTSPIVKSFNRNEC

SEQ ID NO: 16538 - protein, 236 aa, Artificial Sequence
  Description of Artificial Sequence: Synthetic polypeptide
MDMRVPAQLLGLLLLWLRGARCDIQMTQSPSSLSASVGDRVTITCRASQEISGYLSWFQQKPGKAPKSLIYAASTLDSGVPSRFSGSGSGTDFTLTISSLQPEDFATYYCLQYDSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16539 - protein, 236 aa, Artificial Sequence
  Description of Artificial Sequence: Synthetic polypeptide
MDMRVPAQLLGLLLLWLRGARCDIQMTQSPSSLSASVGDRVTITCRASQEISGYLSWYQQKPGKAPKRLIYAASTLDSGVPSRFSGSGSGTEFTLTISSLQPEDFATYYCLQYDSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16540 - protein, 240 aa, Artificial Sequence
  Description of Artificial Sequence: Synthetic polypeptide
  CHIMERIC LC KAPPA SEQUENCE
MESQTQVLISLLFWVSGTCGDIVMTQSPSSLTVIAGEKVTMSCKSSQSLLNSGNQKNYLTWYQQKPGQPPKLLIYWASTRESGVPDRFTGSGSGTDFTLTISSVQAEDLAVYYCQNEYTYPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16541 - protein, 239 aa, Artificial Sequence
  Description of Artificial Sequence: Synthetic polypeptide
  CHIMERIC LC LAMBDA SEQUENCE
MESQTQVLISLLFWVSGTCGDIVMTQSPSSLTVIAGEKVTMSCKSSQSLLNSGNQKNYLTWYQQKPGQPPKLLIYWASTRESGVPDRFTGSGSGTDFTLTISSVQAEDLAVYYCQNEYTYPLTFGAGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 16542 - protein, 240 aa, Artificial Sequence
  Description of Artificial Sequence: Synthetic polypeptide
  HUMANIZED LC KAPPA SEQUENCE 1
MESQTQVLISLLFWVSGTCGDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNEYTYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16543 - protein, 240 aa, Artificial Sequence
  Description of Artificial Sequence: Synthetic polypeptide
  HUMANIZED LC KAPPA SEQUENCE 2
MESQTQVLISLLFWVSGTCGDIQMTQSPSSLSASVGDRVTITCKSSQSLLNSGNQKNYLTWYQQKPGKAPKLLIYWASTRESGVPSRFSGSGSGTDFTLTISSLQPEDFATYYCQNEYTYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16544 - protein, 240 aa, Artificial Sequence
  Description of Artificial Sequence: Synthetic polypeptide
  HUMANIZED LC KAPPA SEQUENCE 3
MESQTQVLISLLFWVSGTCGDIVMTQSPDSLTVSLGERATINCKSSQSLLNSGNQKNYLTWYQQKPGQPPKLLIYWASTRESGVPDRFSGSGSGTDFTLTISSVQAEDVAVYYCQNEYTYPLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16545 - protein, 240 aa, Artificial Sequence
  Description of Artificial Sequence: Synthetic polypeptide
  HUMANIZED LC KAPPA SEQUENCE 4
MESQTQVLISLLFWVSGTCGDIVMTQSPSSLTVSLGERATMSCKSSQSLLNSGNQKNYLTWYQQKPGQPPKLLIYWASTRESGVPDRFSGSGSGTDFTLTISSVQAEDVAVYYCQNEYTYPLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16546 - protein, 234 aa, Artificial Sequence
  Description of Artificial Sequence: Synthetic polypeptide
MGTPAQLLFLLLLWLPDTTGDIQMTQSPSSLSASTGDRVTITCRASQGISSYLAWYQQKPGKAPKLLIYAASTLQSGVPSRFSGSGSGTDFTLTISSLQPEDFATYYCQQYFTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16547 - protein, 216 aa, Artificial Sequence
  Description of Artificial Sequence: Synthetic polypeptide
QSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 16548 - protein, 214 aa, Artificial Sequence
  Description of Artificial Sequence: Synthetic polypeptide
DIQMTQSPSSFSASTGDRVTITCRASQGISSYLAWYQQKPGKAPKLLIYAASTLQSGVPSRFSGSGSGTDFTLTISSLQPEDSATYYCQQYFTFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16549 - protein, 238 aa, Artificial Sequence
  Description of Artificial Sequence: Synthetic polypeptide
  Synthetic sequence: Anti-FAP hu36-IgG1-LC
METDTLLLWVLLLWVPGSTGDIQMTQSPSSLSASVGDRVTITCRASKSVSTSAYSYMHWYQQKPGKAPKLLIYLASNLESGVPSRFSGSGSGTDFTLTISSLQPEDFATYYCQHSRELPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16550 - protein, 220 aa, Homo sapiens
DIVMSQSPSSLAVSVGEKVTMSCKSSQSLLYSRNQKNYLAWFQQKPGQSPKLLIFWASTRESGVPDRFTGSGFGTDFNLTISSVQAEDLAVYDCQQYFSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16551 - protein, 240 aa, Homo sapiens
MDSQAQVLMLLPLWVSGTCGDIVMSQSPSSLAVSVGEKVTMSCKSSQSLLYSRNQKNYLAWFQQKPGQSPKLLIFWASTRESGVPDRFTGSGFGTDFNLTISSVQAEDLAVYDCQQYFSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16552 - protein, 240 aa, Homo sapiens
METDTLLLWVLLLWVPGSSGDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16553 - protein, 235 aa, Artificial Sequence
  Description of Artificial Sequence: Synthetic polypeptide
  Chimeric protein comprising fusion of murine and human sequences
MDFQVQIFSFLLISASVIISRGQIVLTQSPAIMSASPGEKVTMTCSASSGVNFMHWYQQKSGTSPKRWIFDTSKLASGVPARFSGSGSGTSYSLTISSMEAEDAATYYCQQWSFNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16554 - protein, 239 aa, Artificial Sequence
  Description of Artificial Sequence: Synthetic polypeptide
  artificial antibody chain
MKLPVRLLVLMFWIPASLSDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16555 - protein, 211 aa, Artificial Sequence
  Description of Artificial Sequence: Synthetic polypeptide
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16556 - protein, 211 aa, Artificial Sequence
  Description of Artificial Sequence: Synthetic polypeptide
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16557 - protein, 211 aa, Artificial Sequence
  Description of Artificial Sequence: Synthetic polypeptide
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16558 - protein, 211 aa, Artificial Sequence
  Description of Artificial Sequence: Synthetic polypeptide
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16559 - protein, 211 aa, Artificial Sequence
  Description of Artificial Sequence: Synthetic polypeptide
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16560 - protein, 211 aa, Artificial Sequence
  Description of Artificial Sequence: Synthetic polypeptide
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16561 - protein, 211 aa, Artificial Sequence
  Description of Artificial Sequence: Synthetic polypeptide
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16562 - protein, 220 aa, Homo sapiens
DVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16563 - protein, 219 aa, Homo sapiens
EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16564 - protein, 211 aa, Artificial Sequence
  Description of Artificial Sequence: Synthetic polypeptide
  HuL1- kappa
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16565 - protein, 211 aa, Artificial Sequence
  Description of Artificial Sequence: Synthetic polypeptide
  huL2 - kappa
SIVMTQTPKTLSVSAGERVTITCKASQSVSNDVTWYQQKPGQSPKLLIYSASNRYSGVPDRFSGSGYGTAFTFTISSVQAEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16566 - protein, 211 aa, Artificial Sequence
  Description of Artificial Sequence: Synthetic polypeptide
  HuL3 - kappa
SIVMTQTPAFLLVSAGERVTITCRASQSVSNDVTWYQQKAGQAPRLLIYSASNRYTGIPARFSGSGYGTEFTFTISSVQSEDFAVYFCQQDYSSFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16567 - protein, 214 aa, Mus musculus; identical to SEQ ID NO: 12749

SEQ ID NO: 16568 - protein, 213 aa, Artificial Sequence; identical to SEQ ID NO: 13861
  Description of Artificial Sequence: Synthetic polypeptide

SEQ ID NO: 16569 - protein, 214 aa, Mus musculus; identical to SEQ ID NO: 12751

SEQ ID NO: 16570 - protein, 214 aa, Artificial Sequence; identical to SEQ ID NO: 12747
  Description of Artificial Sequence: Synthetic polypeptide

SEQ ID NO: 16571 - protein, 214 aa, Mus musculus; identical to SEQ ID NO: 12746

SEQ ID NO: 16572 - protein, 214 aa, Artificial Sequence; identical to SEQ ID NO: 7396
  Description of Artificial Sequence: Synthetic polypeptide
  humanized   L-chain

SEQ ID NO: 16573 - protein, 220 aa, Mus musculus
  Ab 4785 LC
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQSDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16574 - protein, 222 aa, Mus musculus; identical to SEQ ID NO: 13862

SEQ ID NO: 16575 - protein, 214 aa, Mus musculus
  Ab 4889 LC
DIVMTQSTSSLSASLGDRVTVSCRASQDISNYLNWYQQKPDGTIKLLIYYTSRLHSGVPSRFSGSGSGTDYSLTISNLDQEDIATYFCQQSNTLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16576 - protein, 218 aa, Mus musculus
  Ab 4935 LC
DIQMTQSPASLAVSLGQRATISCRASESVDSYGNTFMHWYQQKPGQPPKLLIYRASNLESGIPARFSGSGSRTDFTLTINPVEADDVATYYCQQSNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16577 - protein, 216 aa, Artificial Sequence; identical to SEQ ID NO: 13863
  Description of Artificial Sequence: Synthetic polypeptide

SEQ ID NO: 16578 - protein, 214 aa, Mus musculus
  Ab 5038 LC
DIVMTQTTSSLSASLGDRVTISCRPSQDISNYVNWFQQKPGGTVKLLIFHTSRLHSGVPSRFSGSGSGTDYSLTISTLEQEDIAIYFCQQGITLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16579 - protein, 216 aa, Artificial Sequence; identical to SEQ ID NO: 13864
  Description of Artificial Sequence: Synthetic polypeptide

SEQ ID NO: 16580 - protein, 214 aa, Mus musculus
  Ab 5082 LC
DIVMTQATSSLSASLGDRVTVSCRASQDINNYLNWYQQKPDGTVKLLIYYTSRLQSGVPSRFSGSGSGIDYSLTISNLEQEDFVTYFCQQSETLPWTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16581 - protein, 221 aa, Mus musculus; identical to SEQ ID NO: 13865

SEQ ID NO: 16582 - protein, 214 aa, Mus musculus
  Ab 5101 LC
QIVLTQSPSSLSASLGDRVTISCRASQDISNYLNWFQQRPDGTVKLLIYYTSRLHSGVPSRFSGSGSGTDYSLTISNLEQEDIATYFCQQGNTLPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16583 - protein, 214 aa, Mus musculus
  Ab 5106 LC
DIVMTQATSSLSASLGDRVTISCSASQDINNYLNWYQQKPDGTIKLLIYYTSSLHSGVPSRFSGSGSGTDYSLTISNLEPEDIATYYCQQYSRIPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16584 - protein, 220 aa, Mus musculus
  Ab 5143 LC
DIVMTQSPSSLTVTAGEKVTMSCKSSQSLLNSGNQKNYMTWYQQKPGQSPKLLIYWASTRESGVPDRFTGSGSGTDFTLTISSVQAEDLAVYYCQNDYSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16585 - protein, 213 aa, Mus musculus
  Ab 5144 LC
HIVLTQSPAIMSASPGEKVTMTCSASSSVSYMYWYQQKPRSSPRLLIYDTSNLASGVPVRFSGSGSGTSYSLTISRMEADDAATYYCQQLSSYPPTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16586 - protein, 213 aa, Mus musculus
  Ab 5259 LC
NIVLTQSPAIMSASPGEKVTMTCSASSSVSYMFWYQQKPGSSPRLLIYDTSNLASGVPVRFSGSGSGTSYSLTISRMEAEDAATYYCQQLNSYPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16587 - protein, 215 aa, Homo Sapiens
EIVLTQSPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16588 - protein, 219 aa, Artificial Sequence; identical to SEQ ID NO: 7710
  Description of Artificial Sequence: Synthetic polypeptide
  Synthetic: antibody A light chain

SEQ ID NO: 16589 - protein, 215 aa, Artificial Sequence; identical to SEQ ID NO: 7603
  Description of Artificial Sequence: Synthetic polypeptide
  humanized   L-chain

SEQ ID NO: 16590 - protein, 234 aa, Mus musculus
MSVLTQVLALLLLWLTGARCDIQMTQSPTSLSASVGETVTITCRTSENIHNFLTWYQQKQGKSPQVLVYNAKTLPDGVPSRFSGSGSGTQYSLKINSLQPEDFGTYYCQHFWSSPWTFGGGTKLEIKRADAAPTVSIFPPSSEQLTSGGASVVCFLNNFTPKDINVKWKIDGSERQNGVLNSWTDQDSKDSTYSMSSTLTLTKDEYERHNSYTCEATHKTSTSPIVKSFNRNEC

SEQ ID NO: 16591 - protein, 233 aa, Homo sapiens
MSVLTQVLALLLLWLTGARCDIQMTQSPTSLSASVGETVTITCRTSENIHNFLTWYQQKQGKSPQVLVYNAKTLPDGVPSRFSGSGSGTQYSLKINSLQPEDFGTYYCQHFWSSPWTFGGGTKLEIKRTVAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16592 - protein, 234 aa, Homo sapiens
MSVLTQVLALLLLWLTGARCDIQMTQSPTSLSASVGETVTITCRTSENIHNFLTWYQQKQGKSPQVLVYNAKTLPDGVPSRFSGSGSETQYSLKINSLQPEDFGTYYCQHFWSSPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16593 - protein, 219 aa, Artificial Sequence
  Description of Artificial Sequence: Synthetic polypeptide
  Human/Murine Chimera G193 light Chain
DIQMTQSPSSLSASVGDRVTITCRSSQRIVHSNGNTYLEWYQQTPGKAPKLLIYKVSNRFSGVPSRFSGSGSGTDFTFTISSLQPEDIATYYCFQGSHVPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16594 - protein, 214 aa, Artificial Sequence
  Description of Artificial Sequence: Synthetic polypeptide
  KV1 light chain
DIQLTQSPSFLSASVGDRVTITCRASQNVDTNLAWYQQKPGKAPKLLIYSASYRYTGVPSRFSGSGSGTEFTLTISSLQPEDFATYYCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16595 - protein, 214 aa, Artificial Sequence
  Description of Artificial Sequence: Synthetic polypeptide
  KV7 light chain
DIQLTQSPSFLSASVGDRVTITCKASQNVDTNVAWYQQKPGKAPKPLIYSASYRYTGVPSRFSGSGSGTEFTLTISSLQPEDFATYYCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16596 - protein, 214 aa, Artificial Sequence
  Description of Artificial Sequence: Synthetic polypeptide
  Synthetic Light chain MCSP clone ML2 (G3) polypeptide
DIQMTQSPSSLSASVGDRVTITCRASQGIRNYLNWYQQKPGKAPKLLIYYTSSLHSGVPSRFSGSGSGTDYTLTISSLQPEDFATYYCQQYSALPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16597 - protein, 238 aa, Artificial Sequence; identical to SEQ ID NO: 12875
  Description of Artificial Sequence: Synthetic polypeptide
  AntiMET-R light chain

SEQ ID NO: 16598 - protein, 218 aa, Artificial Sequence
  Description of Artificial Sequence: Synthetic polypeptide
  Chimeric Cricetulus migratorius and Human
DIVMTQSPSSLAVSAGDTVTINCRSSQSLFSGNYNYLAWYQQKTGQTPKLLISYASTRHTGVPDRFVGSGSGTDFILTIYNFQTEDLGDYYCQQHYSSPRTFGPGTKLKIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16599 - protein, 215 aa, Artificial Sequence; identical to SEQ ID NO: 7856
  Description of Artificial Sequence: Synthetic polypeptide

SEQ ID NO: 16600 - protein, 217 aa, Artificial Sequence
  Description of Artificial Sequence: Synthetic polypeptide
  Caninised anti-NGF VL canine kappa light chain (caN-kLC)
DIQMTQSPASLSLSQEEKVTITCRASEDIYNALAWYQQKPGQAPKLLIYNTDTLHTGVPSRFSGSGSGTEYSLTINSLESEDVAVYFCQHYFHYPRTFGAGTKVELKRNDAQPAVYLFQPSPDQLHTGSASVVCLLNSFYPKDINVKWKVDGVIQDTGIQESVTEQDKDSTYSLSSTLTMSSTEYLSHELYSCEITHKSLPSTLIKSFQRSECQRVD

SEQ ID NO: 16601 - protein, 218 aa, Artificial Sequence
  Description of Artificial Sequence: Synthetic polypeptide
NIVLTQSPASLAVSLGQRATISCRASESVDSYGRSFMHWYQQRPGQPPTLLIYLASNLESGVPVRFSGSGSRTDFTLTIDPVEADDAATYYCQQDNEDPYTFGGGTKLEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16602 - protein, 218 aa, Artificial Sequence
  Description of Artificial Sequence: Synthetic polypeptide
DIVMTQSPDSLAVSLGERATINCRASESVDSYGRSFMHWYQQKPGQAPRLLIYLASNLESGVPSRFSGSGSGTDFTLTINSLEAEDAATYYCQQDNEDPYTFGGGTKLEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16603 - protein, 218 aa, Artificial Sequence
  Description of Artificial Sequence: Synthetic polypeptide
NIVLTQSPASLSVSLGQRATISCRASESVDSYGRSFMHWYQQRPGQAPRLLIYLASNLESGVPARFSGSGSRTDFTLTISSVEAEDEATYYCQQDNEDPYTFGGGTKLEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16604 - protein, 218 aa, Artificial Sequence
  Description of Artificial Sequence: Synthetic polypeptide
NIVLTQSPASLSVSLGQRATISCRASESVDSYGRSFMHWYQQKPGQAPKLLIYLASNLESGVPSRFSGSGSRTDFTLTISAVEAEDAATYYCQQDNEDPYTFGGGTKLEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16605 - protein, 218 aa, Artificial Sequence
  Description of Artificial Sequence: Synthetic polypeptide
NIVLTQSPASLSVSLGQRATISCRASESVDSYGRSFMHWYQQRPGQAPKLLIYLASNLESGVPARFSGSGSRTDFTLTISSVEAEDEATYYCQQDNEDPYTFGGGTKLEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16606 - protein, 218 aa, Artificial Sequence
  Description of Artificial Sequence: Synthetic polypeptide
NIVLTQSPASLSVSLGQRATISCRASESVDSYGRSFMHWYQQKPGQAPKLLIYLASNLESGVPSRFSGSGSRTDFTLTISRVEAEDAATYYCQQDNEDPYTFGGGTKLEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16607 - protein, 107 aa, Artificial Sequence
  Description of Artificial Sequence: Synthetic polypeptide
GTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16608 - protein, 235 aa, Artificial Sequence; identical to SEQ ID NO: 9486
  Description of Artificial Sequence: Synthetic polypeptide
  Synthetic alpha-RANKL-1 light chain

SEQ ID NO: 16609 - protein, 285 aa, Artificial Sequence [sequence omitted]

SEQ ID NO: 16610 - protein, 214 aa, Artificial Sequence
  Description of Artificial Sequence: Synthetic polypeptide
DIVMTQSHKFMSTSVGDRVSITCKASQDVGTNIAWYQQKPGRSPKVLIYSASTRHTGVPDRFTGSGSGTDFTLTISNVQSEDLTDYFCQQYSSFPLTFGVGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16611 - protein, 234 aa, Artificial Sequence
  Description of Artificial Sequence: Synthetic polypeptide
  Chi-83D4 light Chain
MVSTPQFLVFLLFWIPASRGDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16612 - protein, 214 aa, Artificial Sequence
  Description of Artificial Sequence: Synthetic polypeptide
SYVLTQPPSVSVAPGQTARITCGGNNLGSKSVHWYQQKPGQAPVLVVYDDSDRPSWIPERFSGSNSGNTATLTISRGEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 16613 - protein, 112 aa, Artificial Sequence
  Description of Artificial Sequence: Synthetic polypeptide
DIQMTQSPSSLSASVGDRVTINCQASQSIYNNNELSWYQQKPGKPPKLLIYRASTLASGVPSRFSGSGSGTDFTLTISSLQPEDVATYYCGGYKSYSNDGNGFGGGTKVEIK

SEQ ID NO: 16614 - protein, 110 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPPVYTFGQGTKLEIKR

SEQ ID NO: 16615 - protein, 108 aa, Artificial Sequence; identical to SEQ ID NO: 4535
  Description of Artificial Sequence: Synthetic polypeptide

SEQ ID NO: 16616 - protein, 217 aa, Artificial Sequence; identical to SEQ ID NO: 7656
  Description of Artificial Sequence: Synthetic polypeptide

SEQ ID NO: 16617 - protein, 211 aa, Artificial Sequence
  Description of Artificial Sequence: Synthetic polypeptide
  Chimeric 3F8 light chain kappa
SIVMTQTPKFLLVSAGDRVTITCKASQSVSNDVTWYQQKAGQSPKLLIYSASNRYSGVPDRFTGSGYGTAFTFTISTVQAEDLAVYFCQQDYSSFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16618 - protein, 240 aa, Artificial Sequence
  Description of Artificial Sequence: Synthetic polypeptide
  monoclonal antibody chain
MEAPAQLLFLLLLWLPDTTGEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16619 - protein, 216 aa, Homo sapiens
  light chain
DIQMTQSPSSLSASVGDRVTITCRASQDIGNFLNWYQQKPGKAPKLLIYYTSRLQSGVPSRFSGSGSGTDYTLTISSLQPEDFATYYCQQGKTLPYTFGGGTKVEIKDIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16620 - protein, 216 aa, Homo sapiens
  light chain
DIQMTQSPSSLSASVGDRVTITCRASQDIGNFLNWYQQKPGKAPKLLLYYTSRLQSGVPSRFSGSGSGTDYTLTISSLQPEDFATYYCQQGKTLPYTFGGGTKVEIKDIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16621 - protein, 219 aa, Artificial Sequence; identical to SEQ ID NO: 12941
  Description of Artificial Sequence: Synthetic polypeptide
  immunoglobulin light chain

SEQ ID NO: 16622 - protein, 219 aa, Mus musculus
DVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16623 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQSSYYAPVTFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16624 - protein, 203 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYYSSPITGQGTKVEIKRTVAAPSVFIFTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16625 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQASYYSPFTFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16626 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQSYDSYPFTFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16627 - protein, 214 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQSDSYPITFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16628 - protein, 214 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQARKSPITFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16629 - protein, 205 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQASYYSPVTFGQGTKVEIKRTVAAPSVFIFTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16630 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQASYYSPVTFGQGTKVEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16631 - protein, 204 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQSSYSPLTFGQGTKVEIKRTVAAPSVFIFTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16632 - protein, 205 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQSSYYSPGTFGQGTKVEIKRTVAAPSVFIFTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 16633 - protein, 220 aa, Artificial Sequence; identical to SEQ ID NO: 7675
  Description of Artificial Sequence: Synthetic polypeptide

SEQ ID NO: 16634 - protein, 217 aa, Artificial Sequence
  Description of Artificial Sequence: Synthetic polypeptide
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 16635 - protein, 212 aa, Artificial Sequence
  Description of Artificial Sequence: Synthetic polypeptide
QYELTQPPSVSVYPGQTASITCSGDQLGSKFVSWYQQRPGQSPVLVMYKDKRRPSEIPERFSGSNSGNTATLTISGTQAIDEADYYCQAWDSSTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 16636 - protein, 214 aa, Artificial Sequence
  Description of Artificial Sequence: Synthetic polypeptide
DIQMTQSPSSLSASVGDRITITCQASQDIGDSLNWYQQKPGKAPRLLIYDASNLETGVPPRFSGSGSGTDFTFTFRSLQPEDIATYFCQQSANAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16637 - protein, 216 aa, Artificial Sequence
  Description of Artificial Sequence: Synthetic polypeptide
QSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 16638 - protein, 216 aa, Artificial Sequence
  Description of Artificial Sequence: Synthetic polypeptide
QYELTQPASVSGSPGQSITISCTGTSSDIGRWNIVSWYQQHPGKAPKLMIYDVSNRPSGVSNRFSGSKSGNTASLTISGLQAEDEADYYCSSYTSSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 16639 - protein, 214 aa, Artificial Sequence; identical to SEQ ID NO: 12595
  Description of Artificial Sequence: Synthetic polypeptide

SEQ ID NO: 16640 - protein, 219 aa, Artificial Sequence
  Description of Artificial Sequence: Synthetic polypeptide
DIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16641 - protein, 214 aa, Artificial Sequence
  Description of Artificial Sequence: Synthetic polypeptide
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 16642 - protein, 214 aa, Artificial Sequence; identical to SEQ ID NO: 7707
  Description of Artificial Sequence: Synthetic polypeptide

SEQ ID NO: 16643 - protein, 94 aa, Mus sp.
ASPGEKVTMTCRASSSVSYMHWYQQKPGSSPKPWIYATSNLASGVPARFSGSGSGTSYSLTISRVEAEDAATYFCQQWSRNPFTFGSGTKLEIR

SEQ ID NO: 16644 - protein, 94 aa, Mus sp.
ASPGEKVTMTCRASSSVSYMHWYQQKPGSSPKPYIYATSNLSSGVPARFSGSGSGTSYSLTISRVEAEDAATYYCQQWSSNPFTFGSGTKLEIK

SEQ ID NO: 16645 - protein, 113 aa, Mus musculus [sequence omitted]

SEQ ID NO: 16646 - protein, 107 aa, Mus musculus; identical to SEQ ID NO: 13753

SEQ ID NO: 16647 - protein, 105 aa, Artificial Sequence
  Description of Artificial Sequence: Synthetic polypeptide
QIVLTQSPAIMSASPGETVTMTCSASSSITYMHWYQQKPGTSPKRWIYDTSKLASGVPARFSGSGSGTSYSLTISSMEAEDAATYYCHQRSSYTFGGGTKLEIKR

SEQ ID NO: 16648 - protein, 106 aa, Artificial Sequence
  Description of Artificial Sequence: Synthetic polypeptide
QIVLTQSPAIMSASPGEKVTMTCSASSSVSYMHWYQQKSGTSPKRWIFDTSKLASGVPARFSGSGSGTSYSLTISSMEAEDAATYYCQQWSSNLLTFGAGTKLELK

SEQ ID NO: 16649 - protein, 108 aa, Artificial Sequence [sequence omitted]

SEQ ID NO: 16650 - protein, 108 aa, Artificial Sequence
  Description of Artificial Sequence: Synthetic polypeptide
DIQMTQSPSSLSASVGDRVTITCKASENVVSYVSWYQQKPGKAPKLLIYGASNRNTGVPSRFSGSGSGTDFTLTISSLQPEDFATYYCGQSYNYPYTFGQGTKLEIKR

SEQ ID NO: 16651 - protein, 108 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKR

SEQ ID NO: 16652 - protein, 108 aa, Artificial Sequence
  Description of Artificial Sequence: Synthetic polypeptide
DIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKR

SEQ ID NO: 16653 - protein, 114 aa, Artificial Sequence; identical to SEQ ID NO: 9375
  Description of Artificial Sequence: Synthetic polypeptide
  sequence is synthesized

SEQ ID NO: 16654 - protein, 107 aa, Artificial Sequence
  Description of Artificial Sequence: Synthetic polypeptide
DIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 16655 - protein, 105 aa, Artificial Sequence
  Description of Artificial Sequence: Synthetic polypeptide
QIVLTQSPAIMSASPGEKVTMTCSASSSISYMHWYHQKPGTSPKRWIYDTSKLASGVPARFSGSGSGTSYSLTISSMEAEDAATYYCHQRSSYTFGGGTKLEIKR

SEQ ID NO: 16656 - protein, 108 aa, Artificial Sequence
  Description of Artificial Sequence: Synthetic polypeptide
QIVLTQSPAIMSASPGEKVTMTCSASSSVSYIHWYQQKSGTSPKRWIYDTSKLASGVPARFSGSGSGTSYSLTISSMEAEDAATYYCQQWSSNPPMLTFGAGTKLELK

SEQ ID NO: 16657 - protein, 106 aa, Artificial Sequence
  Description of Artificial Sequence: Synthetic polypeptide
QIVLTQSPAIMSASPGEKVTMTCSASSSVSYMHWFQQKSGTSPKRWIYDTSKLASGVPARFSGSGSGTSYSLTISSMEAEDAATYYCQQWSSNLLTFGAGTKLELK

SEQ ID NO: 16658 - protein, 106 aa, Artificial Sequence
  Description of Artificial Sequence: Synthetic polypeptide
QIVLTQSPAVMSASPGEKVAITCSASSSVSYMHWFQQKPGTSPKLWIYSTSNLASGVPARFSGSGSGTSYSLTISRMEAEDAATYYCQQRSSYPWTFGGGTKLEIK

SEQ ID NO: 16659 - protein, 106 aa, Artificial Sequence
  Description of Artificial Sequence: Synthetic polypeptide
  Amino acid sequence identified using molecular biology technique
QIVLTQSPAIMSASPGEKVTMTCSASSSVSDMHWYQQKSGTSPKRWIYDTSKLASGVPARFSGSGSGTSYSLTINSMEAEDAASYYCQQWSSYPFTFGSGTKLEIK

SEQ ID NO: 16660 - protein, 109 aa, Artificial Sequence
  Description of Artificial Sequence: Synthetic polypeptide
  Amino acid sequence identified using molecular biology technique
QIVLIQSPAIMSAFPGERVTMTCSASLSVTYMYWYQQRPGSSPRLLISDTSNLASGVPVRFSGSGSGTSYSLTISRVEAEDAATYYCQQWSYYPVTFGAGTKLELKRAD

SEQ ID NO: 16661 - protein, 107 aa, Artificial Sequence
  Description of Artificial Sequence: Synthetic polypeptide
  Amino acid sequence identified using molecular biology technique
DIVMTQSQKFMSTTVGDRVSITCKASQNVGTAVAWYQQKPGQSPKLLIYSASNRFTGVPDRFTGSGSGRDFTLTISNMQSEDLADYFCQQYSTYPLTFGTGTRLEVK

SEQ ID NO: 16662 - protein, 107 aa, Artificial Sequence
  Description of Artificial Sequence: Synthetic polypeptide
  Synthetic cImmu31Vk protein sequence
DIQLTQSPSSLSASLGGKVTITCKASQDINKYIGWYQHKPGKGPRLLMHYTSALLPGIPSRFSGSGSGRDYSFSISNLEPEDIATYYCLQYDDLWTFGGGTKLEIKR

SEQ ID NO: 16663 - protein, 107 aa, Artificial Sequence
  Description of Artificial Sequence: Synthetic polypeptide
  Synthetic hImmu31Vk protein sequence
DIQLTQSPSSLSASVGDRVTITCKASQDINKYIGWYQQKPGKAPKLLMHYTSALLPGIPSRFSGSGSGTDYTFTISSLQPEDIATYYCLQYDDLWTFGGGTKLQIKR

SEQ ID NO: 16664 - protein, 107 aa, Artificial Sequence
  Description of Artificial Sequence: Synthetic polypeptide
  hImmu31VkT39 protein sequence
DIQLTQSPSSLSASVGDRVTITCKASQDINKYIGWYQQTPGKAPKLLMHYTSALLPGIPSRFSGSGSGRDYTFTISSLQPEDIATYYCLQYDDLWTFGGGTKLQIKR

SEQ ID NO: 16665 - protein, 107 aa, Artificial Sequence
  Description of Artificial Sequence: Synthetic polypeptide
  Synthetic Immu31Vk protein sequence
DIQLTQSPSSLSASLGGKVTITCKASQDINKYIGWYQHKPGKGPRLLMHYTSALLPGIPSRFSGSGSGRDYSFSISNLEPEDIATYYCLQYDDLWTFGGGTKLEMKR

SEQ ID NO: 16666 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCSGSSSNIGNNAVNWYQQLPGTAPKLLIYADSNRPSGVPDRFSGSKSGTSASLAISGLRSEDEADYYCGSWDYSLSGYVFGGGTKLTVLG

SEQ ID NO: 16667 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCSGSSSNIGNNYVTWYQQLPGTAPKLLIYADSHRPSGVPDRFSGSKSGTSASLAISGLRSEDEADYYCATWDYSLSGYVFGGGTKLTVLG

SEQ ID NO: 16668 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCSGSSSNIGNNDVYWYQQLPGTAPKLLIYANSHRPSGVPDRFSGSKSGTSASLAISGLRSEDEADYYCGTWDYSLSGYVFGGGTKLTVLG

SEQ ID NO: 16669 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCTGSSSNIGNNDVSWYQQLPGTAPKLLIYSDSKRPSGVPDRFSGSKSGTSASLAISGLRSEDEADYYCGSWDYSLSGYVFGGGTKLTVLG

SEQ ID NO: 16670 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCSGSSSNIGSNAVNWYQQLPGTAPKLLIYADSNRPSGVPDRFSGSKSGTSASLAISGLRSEDEADYYCGSWDYSLSGYVFGGGTKLTVLG

SEQ ID NO: 16671 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCTGSSSNIGNNAVSWYQQLPGTAPKLLIYSDSQRPSGVPDRFSGSKSGTSASLAISGLRSEDEADYYCATWDYSLSAYVFGGGTKLTVLG

SEQ ID NO: 16672 - protein, 111 aa, Artificial Sequence
  Description of Artificial Sequence: Synthetic polypeptide
  Synthetic light chain antigen binding region (light chain variable region) of anti-Ang2 antibody
QSVLTQPPSASGTPGQRVTISCSGSSSNIGSNYVNWYQQLPGTAPKLLIYSDSHRPSGVPDRFSGSKSGTSASLAISGLRSEDEADYYCGAWDDSLSGYVFGGGTKLTVLG

SEQ ID NO: 16673 - protein, 111 aa, Artificial Sequence
  Description of Artificial Sequence: Synthetic polypeptide
  light chain antigen binding region(light chain variable region) of anti-Ang2 antibody
QSVLTQPPSASGTPGQRVTISCTGSSSNIGSNYVSWYQQLPGTAPKLLIYSDNKRPSGVPDRFSGSKSGTSASLAISGLRSEDEADYYCGTWDDSLNGYVFGGGTKLTVLG

SEQ ID NO: 16674 - protein, 111 aa, Artificial Sequence
  Description of Artificial Sequence: Synthetic polypeptide
  light chain antigen binding region (light chain variable region) of anti-Ang2 antibody
DIVLTQSPASLAVSLGQRATISCRASESVDSYGNSFMHWYQQKPGQPPKLLIYRASNLDSGIPARFSGSGSRTDFTLTINPVEADDVATYYCQQSNEDPLTFGAGTKLELK

SEQ ID NO: 16675 - protein, 107 aa, Artificial Sequence
  Description of Artificial Sequence: Synthetic polypeptide
  light chain antigen binding region(light chain variable region) of anti-Ang2 antibody
DIQMTQTTSSLSASLGDRVTISCRASQDISNYLNWYQQKPDGTVKLLIYYTSRLHSGVPSRFSGSGSGTDYSLTITNLEQEDIATYFCQQGNTLPWTFGGGTKLEIK

SEQ ID NO: 16676 - protein, 107 aa, Artificial Sequence
  Description of Artificial Sequence: Synthetic polypeptide
  light chain antigen binding region(light chain variable region) of anti-Ang2 antibody
TIVMTQTPKFLLVSAGDRITITCKASQSVSNDVAWYQQKPGQSPKLLIYYASNRYPGVPDRFTGSGYGTDFTFTISTVQAEDLAVYFCQQDYTSPWTFGGGTELEIK

SEQ ID NO: 16677 - protein, 107 aa, Artificial Sequence
  Description of Artificial Sequence: Synthetic polypeptide
  light chain antigen binding region(light chain variable region) of anti-Ang2 antibody
DIQMTQTTSSLSASLGDRVTISCSTSQGISNYLNWYQQKPDGTVKLLIFYTSSLHSGVPSRFSGSGSGTDYSLTISNLEPEDIATYYCQQYSKLPYTFGGGTKLEIK

SEQ ID NO: 16678 - protein, 141 aa, Artificial Sequence
  Description of Artificial Sequence: Synthetic polypeptide
MRCLAEFLGLLVLWIPGAIGDIVMTQAAPSVPVTPGESVSISCRSSKSLLHSNGNTYLYWFLQRPGQSPQLLIYRMSNLVSGVPDRFSGSGSGTAFTLRISRVEAEDVGVYYCLQHLEYPFTFGPGTKLELKRADAAPTVT

SEQ ID NO: 16679 - protein, 108 aa, Artificial Sequence
  Description of Artificial Sequence: Synthetic polypeptide
  antibody
DIQMTQSPSSLSASVGDRVTITCRASKTISKYLAWYQQKPGKAPKLLIYSGSTLQSGVPSRFSGSGSGTDFTLTISSLQPEDFATYYCQQHNEYPLTFGQGTKVEIKR

SEQ ID NO: 16680 - protein, 112 aa, Artificial Sequence
  Description of Artificial Sequence: Synthetic polypeptide
  CD19 (8B8-5B08) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLDSYPNTFGQGTKLEIK

SEQ ID NO: 16681 - protein, 112 aa, Artificial Sequence
  Description of Artificial Sequence: Synthetic polypeptide
  Anti-CD19 single variable domain VL (clone 4G7)
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELK

SEQ ID NO: 16682 - protein, 112 aa, Artificial Sequence
  Description of Artificial Sequence: Synthetic polypeptide
  CD19 (8B8-018) VL
DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 16683 - protein, 112 aa, Artificial Sequence
  Description of Artificial Sequence: Synthetic polypeptide
  CD19 (8B8-2B03) VL
  MOD_RES (107)..(107): Any naturally occurring amino acid
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHVPYTFGQGXKLEIK

SEQ ID NO: 16684 - protein, 112 aa, Artificial Sequence
  Description of Artificial Sequence: Synthetic polypeptide
  CD19 (8B8-2B11) VL
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 16685 - protein, 112 aa, Artificial Sequence
  Description of Artificial Sequence: Synthetic polypeptide
  CD19 (8B8-5A07) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQPGHYPGTFGQGTKLEIK

SEQ ID NO: 16686 - protein, 112 aa, Artificial Sequence
  Description of Artificial Sequence: Synthetic polypeptide
  CD19 (8B8-5D08) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHEPYTFGQGTKLEIK

SEQ ID NO: 16687 - protein, 112 aa, Artificial Sequence
  Description of Artificial Sequence: Synthetic polypeptide
  CD19 (8B8-5H09) VL
DIVMTQTPLSLSVTPGQPASISCKSSQSLESSTGNTYLNWYLQKPGQSPQLLIYRVSKRFSGVPDRFSGSGSGTDFTLKISRVEAEDVGVYYCLQLIDYPVTFGQGTKLEIK

SEQ ID NO: 16688 - protein, 112 aa, Artificial Sequence
  Description of Artificial Sequence: Synthetic polypeptide
  CD19 (8B8-7H07) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQATHIPYTFGQGTKLEIK

SEQ ID NO: 16689 - protein, 112 aa, Artificial Sequence; identical to SEQ ID NO: 8175
  Description of Artificial Sequence: Synthetic polypeptide
  anti-CD19 antibody, cA19

SEQ ID NO: 16690 - protein, 112 aa, Artificial Sequence; identical to SEQ ID NO: 8177
  Description of Artificial Sequence: Synthetic polypeptide
  Chimeric cA19Vk antibody

SEQ ID NO: 16691 - protein, 112 aa, Artificial Sequence; identical to SEQ ID NO: 8174
  Description of Artificial Sequence: Synthetic polypeptide
  humanized hA19Vk antibody

SEQ ID NO: 16692 - protein, 111 aa, Artificial Sequence; identical to SEQ ID NO: 11102
  Description of Artificial Sequence: Synthetic polypeptide
  Synthetic CD19 VL

SEQ ID NO: 16693 - protein, 107 aa, Artificial Sequence; identical to SEQ ID NO: 8183
  Description of Artificial Sequence: Synthetic polypeptide
  light chain variable

SEQ ID NO: 16694 - protein, 107 aa, Artificial Sequence; identical to SEQ ID NO: 8292
  Description of Artificial Sequence: Synthetic polypeptide
  light chain variable

SEQ ID NO: 16695 - protein, 107 aa, Artificial Sequence; identical to SEQ ID NO: 8061
  Description of Artificial Sequence: Synthetic polypeptide
  CRIS7 VL

SEQ ID NO: 16696 - protein, 107 aa, Artificial Sequence
  Description of Artificial Sequence: Synthetic polypeptide
  DRA161 VL
DIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITR

SEQ ID NO: 16697 - protein, 106 aa, Artificial Sequence [sequence omitted]

SEQ ID NO: 16698 - protein, 107 aa, Artificial Sequence
  Description of Artificial Sequence: Synthetic polypeptide
  Chimeric Sequence (hOL)
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 16699 - protein, 106 aa, Artificial Sequence [sequence omitted]

SEQ ID NO: 16700 - protein, 106 aa, Artificial Sequence
  Description of Artificial Sequence: Synthetic polypeptide
  Synthetic CD3 VL
DIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQIT

SEQ ID NO: 16701 - protein, 112 aa, Artificial Sequence; identical to SEQ ID NO: 8113
  Description of Artificial Sequence: Synthetic polypeptide
  Synthetic Construct

SEQ ID NO: 16702 - protein, 112 aa, Artificial Sequence; identical to SEQ ID NO: 8115
  Description of Artificial Sequence: Synthetic polypeptide
  Synthetic Construct

SEQ ID NO: 16703 - protein, 106 aa, Artificial Sequence [sequence omitted]

SEQ ID NO: 16704 - protein, 112 aa, Artificial Sequence; identical to SEQ ID NO: 8117
  Description of Artificial Sequence: Synthetic polypeptide
  Synthetic Construct

SEQ ID NO: 16705 - protein, 112 aa, Artificial Sequence; identical to SEQ ID NO: 8118
  Description of Artificial Sequence: Synthetic polypeptide
  Synthetic Construct

SEQ ID NO: 16706 - protein, 112 aa, Artificial Sequence; identical to SEQ ID NO: 8119
  Description of Artificial Sequence: Synthetic polypeptide
  Synthetic Construct

SEQ ID NO: 16707 - protein, 109 aa, Artificial Sequence
  Description of Artificial Sequence: Synthetic polypeptide
  VL humanized CD3 binder polypeptide
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVL

SEQ ID NO: 16708 - protein, 111 aa, Artificial Sequence
  Description of Artificial Sequence: Synthetic polypeptide
  VL  CD3  clone 7-43(11) polypeptide
QTVVTQEPSLTVSPGGTVTLTCGSSTGAVTTSNYANWVQQKPGQAPRGLIGGTNKRAPGTPARFSGSLLGGKAALTLSGVQPEDEAEYYCALWYSNLWVFGGGTKLTVLSS

SEQ ID NO: 16709 - protein, 113 aa, Artificial Sequence; identical to SEQ ID NO: 8696
  Description of Artificial Sequence: Synthetic polypeptide

SEQ ID NO: 16710 - protein, 111 aa, Homo sapiens; identical to SEQ ID NO: 6320

SEQ ID NO: 16711 - protein, 113 aa, Artificial Sequence; identical to SEQ ID NO: 6321
  Description of Artificial Sequence: Synthetic polypeptide

SEQ ID NO: 16712 - protein, 111 aa, Mus musculus; identical to SEQ ID NO: 8695

SEQ ID NO: 16713 - protein, 108 aa, Artificial Sequence
  Description of Artificial Sequence: Synthetic polypeptide
  CH1A1A; VL
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIK

SEQ ID NO: 16714 - protein, 106 aa, Homo sapiens
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIK

SEQ ID NO: 16715 - protein, 106 aa, Mus sp.
EIQLTQSHKMMSTSVGDRVSITCKASQDVGTSVAWYQQRPGQSPKLLIYWTSTRHTGVPDRFTGSVSGTDFTLTITNVQSEDLADYFCQQYSLYRSFGGGTKLEIK

SEQ ID NO: 16716 - protein, 106 aa, Artificial Sequence
  Description of Artificial Sequence: Synthetic polypeptide
  CEA(sm9b) VL
ENVLTQSPSSMSVSVGDRVTIACSASSSVPYMHWLQQKPGKSPKLLIYSTSNLASGVPSRFSGSGSGTDYSLTISSVQPEDAATYYCQQRSSYPLTFGCGTKLEIK

SEQ ID NO: 16717 - protein, 131 aa, Artificial Sequence
  Description of Artificial Sequence: Synthetic polypeptide
  anti-mu CEA T84.66 VL
METDTLLLWVLLLWVPGSTGDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIK

SEQ ID NO: 16718 - protein, 111 aa, Artificial Sequence
  Description of Artificial Sequence: Synthetic polypeptide
  Parental CEA binder VL
DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIK

SEQ ID NO: 16719 - protein, 111 aa, Artificial Sequence
  Description of Artificial Sequence: Synthetic polypeptide
  CEA(T84.66-LCHA) VL
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 16720 - protein, 108 aa, Artificial Sequence; identical to SEQ ID NO: 13065
  Description of Artificial Sequence: Synthetic polypeptide

SEQ ID NO: 16721 - protein, 110 aa, Artificial Sequence
  Description of Artificial Sequence: Synthetic polypeptide
  Light chain variable region of synthetic 1F12 scFv A/a sequenc
QSVLTQPPSASGTPGQRVTISCTGSSSNIGNNYVTWYQQLPGTAPKLLIYYNNHRPSGVPDRFSGSKSGTSASLAISGLQSEDEADYYCGSWDYSLSAYVFGGGTKLTVL

SEQ ID NO: 16722 - protein, 112 aa, Mus musculus; identical to SEQ ID NO: 13105

SEQ ID NO: 16723 - protein, 112 aa, Mus musculus; identical to SEQ ID NO: 13106

SEQ ID NO: 16724 - protein, 112 aa, Mus musculus; identical to SEQ ID NO: 13107

SEQ ID NO: 16725 - protein, 112 aa, Mus musculus; identical to SEQ ID NO: 13108

SEQ ID NO: 16726 - protein, 110 aa, Artificial Sequence
  Description of Artificial Sequence: Synthetic polypeptide
  Light chain variable region of synthetic 2A01 scFv A/a sequence
QSVLTQPPSASGTPGQRVTISCSGSSSNIGNNDVSWYQQLPGTAPKLLIYPDSQRPSGVPDRFSGSKSGTSASLAISGLRSEDEADYYCASWDSSLSGYVFGGGTKLTVL

SEQ ID NO: 16727 - protein, 110 aa, Artificial Sequence
  Description of Artificial Sequence: Synthetic polypeptide
  Light chain variable region of synthetic 2C03 scFv A/a sequence
QSVLTQPPSASGTPGQRVTISCTGSSSNIGSNYVSWYRQLPGTAPKLLIYSDSNRPSGVPDRFSGSKSGTSASLAISGLRSEDEADYYCGSWDDSLSGYVFGGGTKLTVL

SEQ ID NO: 16728 - protein, 114 aa, Artificial Sequence; identical to SEQ ID NO: 13050
  Description of Artificial Sequence: Synthetic polypeptide
  Synthetic (light chain variable region of anti-c-Met antibody (AbF46 or huAbF46-H1))

SEQ ID NO: 16729 - protein, 114 aa, Artificial Sequence; identical to SEQ ID NO: 13048
  Description of Artificial Sequence: Synthetic polypeptide
  Synthetic (amino acid sequence of light chain variable region of antibody L3-11Y)

SEQ ID NO: 16730 - protein, 113 aa, Artificial Sequence
  Description of Artificial Sequence: Synthetic polypeptide
  light chain variable region sequence of LMH-80
DIVMSQSPSSLTVSVGEKVAMSCKSSQSLLYSSNQKDYLAWYQQKPGQSPKLLIYWASTRESGVPDRFTGSGSGTDFTLTISSVKAEDLAVYYCQQYYSYPLTFGAGTKLELK

SEQ ID NO: 16731 - protein, 112 aa, Artificial Sequence
  Description of Artificial Sequence: Synthetic polypeptide
  light chain variable region sequence of LMH-82
DVLMTQTPLSLPVSLGDQASISCRSSQSILHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 16732 - protein, 106 aa, Artificial Sequence
  Description of Artificial Sequence: Synthetic polypeptide
  light chain variable region sequence of LMH-85
QIVLSQSPAILSASPGEKVTMTCRASSGVNYMHWYQQKPGSSPKPWIYATSNLASGVPARFSGSGSGTSYSLTISRVEAEDAATYYCQQWISHPFTFGSGTKLEIK

SEQ ID NO: 16733 - protein, 112 aa, Artificial Sequence
  Description of Artificial Sequence: Synthetic polypeptide
  light chain variable region of antibody LMH-87
DIVMTQAAPSVPVTPGESVSISCRSSKSLLHSNGNTYLYWFLQRPGQSPQVLIYRMSNLASGVPDRFSGSGSGTAFTLRIRRVEAEDVGVYYCMQNLEYPFTFGGGTKLEIK

SEQ ID NO: 16734 - protein, 107 aa, Homo Sapiens; identical to SEQ ID NO: 13066

SEQ ID NO: 16735 - protein, 106 aa, Homo Sapiens
QLTQSPSSLSASVGDRVTITCRASQGLSSALAWYRQKPGKAPKLLIYDASSLESGVPSRFSGSGSGTDFTLTISSLQPEDFATYYCQQFTSYPQITFGQGTRLEIK

SEQ ID NO: 16736 - protein, 107 aa, Artificial Sequence
  Description of Artificial Sequence: Synthetic polypeptide
  synthetic constuct
ETTVTQSPALMAASPGEKVTITCSVSSSISSTNLHWYQQKSETSPKPWIYGTSNLASGVPVRFGGSGSGTSYSLTISSMEAEDAATYYCQQWSSYPYTFGGGTKLEI

SEQ ID NO: 16737 - protein, 108 aa, Artificial Sequence [sequence omitted]

SEQ ID NO: 16738 - protein, 98 aa, Artificial Sequence
  Description of Artificial Sequence: Synthetic polypeptide
DRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKR

SEQ ID NO: 16739 - protein, 114 aa, Artificial Sequence; identical to SEQ ID NO: 13049
  Description of Artificial Sequence: Synthetic polypeptide
  Synthetic (light chain variable region of anti c-Met antibody)

SEQ ID NO: 16740 - protein, 132 aa, Artificial Sequence
  Description of Artificial Sequence: Synthetic polypeptide
  a light chain variable region
MGWSYIILFLVATAADVHSQSALTQPASVSGSPGQSITISCTGTISDIGTYDFVSWYQHKPGKAPKLLIFDVNNRPSGVSSRFSGSKSDNTASLSISGFQAEDEADYYCSSYTDNRGLVLFGGGTKLTVLRS

SEQ ID NO: 16741 - protein, 107 aa, Artificial Sequence
  Description of Artificial Sequence: Synthetic polypeptide
  synthetic construct
EIQMTQSPASLSASVGETVTITCRASENIYSYLAWYQRKQGRSPQLLVYNAKPLAEGVPSRFSGSGSGTQFSLKINSLQPEDFGTYYCQHHYGTPFTFGSGTRLEIK

SEQ ID NO: 16742 - protein, 113 aa, Artificial Sequence; identical to SEQ ID NO: 13137
  Description of Artificial Sequence: Synthetic polypeptide
  Synthetic (light chain variable region of AT-Vk1)

SEQ ID NO: 16743 - protein, 113 aa, Artificial Sequence; identical to SEQ ID NO: 13138
  Description of Artificial Sequence: Synthetic polypeptide
  Synthetic (light chain variable region of AT-Vk2)

SEQ ID NO: 16744 - protein, 113 aa, Artificial Sequence; identical to SEQ ID NO: 13139
  Description of Artificial Sequence: Synthetic polypeptide
  Synthetic (light chain variable region of AT-Vk3)

SEQ ID NO: 16745 - protein, 113 aa, Artificial Sequence; identical to SEQ ID NO: 13140
  Description of Artificial Sequence: Synthetic polypeptide
  Synthetic (light chain variable region of AT-Vk4)

SEQ ID NO: 16746 - protein, 114 aa, Artificial Sequence; identical to SEQ ID NO: 13041
  Description of Artificial Sequence: Synthetic polypeptide
  Synthetic (light chain variable region of anti-c-Met antibody)

SEQ ID NO: 16747 - protein, 108 aa, Artificial Sequence
  Description of Artificial Sequence: Synthetic polypeptide
  DR5 (22E9) binder; variable light chain (VL)
EIVLTQSPGTLSLSPGERATLSCRASQSVSSSYLAWYQQKPGQAPRLLIYGASSRATGIPDRFSGSGSGTDFTLTISRLEPEDFAVYYCQQGSNQPVTFGQGTKVEIK

SEQ ID NO: 16748 - protein, 111 aa, Artificial Sequence
  Description of Artificial Sequence: Synthetic polypeptide
  DR5 (174-VL15) binder; variable light chain (VL)
ADIQMTQSPSTLSASVGDRVTITCRASQSISTYLSWYQQKPGKAPKRLIYKASSLASGVPSRFSGSGSGTEFTLTISSLQPDDAATYYCQPNSGIATYGAAFGGGTKVEIK

SEQ ID NO: 16749 - protein, 108 aa, Artificial Sequence
  Description of Artificial Sequence: Synthetic polypeptide
  DR5(18F11) binder_Variable light chain (VL)
EIVLTQSPGTLSLSPGERATLSCRASQSVSSSYLAWYQQKPGQAPRLLIYGASSRATGIPDRFSGSGSGTDFTLTISRLEPEDFAVYYCQQGQLPPITFGQGTKVEIK

SEQ ID NO: 16750 - protein, 108 aa, Artificial Sequence
  Description of Artificial Sequence: Synthetic polypeptide
  DR5(20F2) binder; variable light chain (VL)
EIVLTQSPGTLSLSPGERATLSCRASQSVSSSYLAWYQQKPGQAPRLLIYGASSRATGIPDRFSGSGSGTDFTLTISRLEPEDFAVYYCQQGESPPPTFGQGTKVEIK

SEQ ID NO: 16751 - protein, 108 aa, Artificial Sequence
  Description of Artificial Sequence: Synthetic polypeptide
  DR5(21H3) binder; variable light chain (VL)
EIVLTQSPGTLSLSPGERATLSCRASQSVSSSYLAWYQQKPGQAPRLLIYGASSRATGIPDRFSGSGSGTDFTLTISRLEPEDFAVYYCQQGSQPPITFGQGTKVEIK

SEQ ID NO: 16752 - protein, 108 aa, Artificial Sequence
  Description of Artificial Sequence: Synthetic polypeptide
  DR5 (5E11) binder_variable light chain (VL)
EIVLTQSPGTLSLSPGERATLSCRASQSVSSSYLAWYQQKPGQAPRLLIYGASSRATGIPDRFSGSGSGTDFTLTISRLEPEDFAVYYCQQGTTHPITFGQGTKVEIK

SEQ ID NO: 16753 - protein, 110 aa, Artificial Sequence
  Description of Artificial Sequence: Synthetic polypeptide
  DR5 (TAA-0006) binder; variable light chain (VL)
LVMTQTPSSTSEPVGGTVTIKCQASQSIGSSLSWYQQKPGQPPKLLIYHASTLASGVPSRFSGSRSGIQTTLTISGVQCDDAATYYCLGVADARRDDGFAFGGGTEVVVK

SEQ ID NO: 16754 - protein, 110 aa, Artificial Sequence
  Description of Artificial Sequence: Synthetic polypeptide
  DR5 (TAA-0010) binder; variable light chain (VL)
AYDMTQTPDSVEVAVGGTVTIKCQASQTIGDALAWYQQKPGQRPNLLIYRTSTLASGVPSRFSGSGSGTHFTLTISGVECADAATYYCQQGATYNNVLNTFGGGTEVVVK

SEQ ID NO: 16755 - protein, 111 aa, Artificial Sequence
  Description of Artificial Sequence: Synthetic polypeptide
  DR5 (TAA-0011) binder; variable light chain (VL)
ADIVMTQTPASVSEPVGGTVTIKCQASQSISTYLSWYQQKPGQPPKRLIYKASTLASGVPSRFKGSGSGTDFTLTIRDLECADAATYYCQPNSGIATYGAAFGGGTEVVVK

SEQ ID NO: 16756 - protein, 110 aa, Artificial Sequence
  Description of Artificial Sequence: Synthetic polypeptide
  DR5 (TAA-0013) binder;variable light chain (VL)
LVMTQTPSSTSEPVGGTVTIKCQASQSIGSSLSWYQQTPGQPPKLLIYTASSLASSVPKRFSGSRSGTQFTLTISGVQCADAATYYCLGIDDVRRDDGFAFGGGTEVVVK

SEQ ID NO: 16757 - protein, 113 aa, Artificial Sequence
  Description of Artificial Sequence: Synthetic polypeptide
  DR5 (TAA-0016) binder; variable heavy chain (VH)
ADIVMTQTASPVSAAVGGTVTINCQASQSISSSYVSWYQQKPGQPPKLLIYKASTLASGVPSRFSGSGSGTQLSLTIRGVQCDDAATYYCLYGYSDVSSSEYVFGGGTEVVVR

SEQ ID NO: 16758 - protein, 110 aa, Artificial Sequence
  Description of Artificial Sequence: Synthetic polypeptide
  DR5 (TAA-0019) binder; variable light chain (VL)
ALVMTQTPSSVSAAVGGTVTINCQASQNIYSNLAWFQQKPGQPPKLLIYETSKLASGVPSRFSGSGSGTEFTLTISDLECDDAATYYCQSSWHSISTDCAFGGGTEVVVK

SEQ ID NO: 16759 - protein, 111 aa, Artificial Sequence
  Description of Artificial Sequence: Synthetic polypeptide
  DR5 (TAA-0052) binder; variable light chain (VL)
ADIVMTQTPASVSEPVGGTVTIKCQASQSISTYLSWYQQKPGQPPKRLIYKASTLASGVPSRFKGSGSGTDFTLTIRDLESADAATYYCQPNSGIATYGAAFGGGTEVVVK

SEQ ID NO: 16760 - protein, 110 aa, Artificial Sequence
  Description of Artificial Sequence: Synthetic polypeptide
  DR5 (174-VL10) binder; variable light chain (VL)
DIQMTQSPSSLSASVGDRVTITCRASQSISTYLSWYQQKPGQPPKRLIYKASTLASGVPSRFSGSGSGTDFTLTISSLQPEDFATYYCQPNSGIATYGAAFGGGTKVEIK

SEQ ID NO: 16761 - protein, 110 aa, Artificial Sequence
  Description of Artificial Sequence: Synthetic polypeptide
  DR5 (174-VL11) binder; variable light chain (VL)
DIQMTQSPSSLSASVGDRVTITCQASQSISTYLSWYQQKPGQPPKRLIYKASTLASGVPSRFSGSGSGTDFTLTISSLQPEDFATYYCQPNSGIATYGAAFGGGTKVEIK

SEQ ID NO: 16762 - protein, 110 aa, Artificial Sequence
  Description of Artificial Sequence: Synthetic polypeptide
  DR5 (174-VL2) binder; variable light chain (VL)
DIQMTQSPSTLSASVGDRVTITCRASQSISTYLSWYQQKPGKAPKRLIYKASSLASGVPSRFSGSGSGTEFTLTISSLQPDDAATYYCQPNSGIATYGAAFGGGTKVEIK

SEQ ID NO: 16763 - protein, 110 aa, Artificial Sequence
  Description of Artificial Sequence: Synthetic polypeptide
  DR5 (174-VL3) binder; variable light chain (VL)
DIQMTQSPSSLSASVGDRVTITCRASQSISTYLSWYQQKPGKAPKRLIYKASTLASGVPSRFSGSGSGTDFTLTISSLQPEDAATYYCQPNSGIATYGAAFGGGTKVEIK

SEQ ID NO: 16764 - protein, 108 aa, Artificial Sequence
  Description of Artificial Sequence: Synthetic polypeptide
  DR5 (TAA-0005) binder; variable light chain (VL)
QVLTQTPSPVSAAVGGTVTINCQASQSVYNNRLAWYQQKPGQPPKLLIYLASTLASGVPSRFKGSGSGTQFTLTISDLQCDDAATYYCAGGYSGNINAFGGGTEVVVK

SEQ ID NO: 16765 - protein, 113 aa, Artificial Sequence
  Description of Artificial Sequence: Synthetic polypeptide
  Chimeric Sequence (h5L)
DIVMTQSPLSLPVTPGEPASISCRSSQNIVHNNGITYLEWYLQKPGQSPQLLIYKVSDRFSGVPDRFSGSGSGTDFTLKISRVEAEDVGVYYCFQGSHIPPTFGQGTKVEIKR

SEQ ID NO: 16766 - protein, 219 aa, Homo sapiens; identical to SEQ ID NO: 13814

SEQ ID NO: 16767 - protein, 216 aa, Homo sapiens; identical to SEQ ID NO: 13816

SEQ ID NO: 16768 - protein, 215 aa, Homo sapiens; identical to SEQ ID NO: 13818

SEQ ID NO: 16769 - protein, 216 aa, Homo sapiens; identical to SEQ ID NO: 13819

SEQ ID NO: 16770 - protein, 215 aa, Homo sapiens; identical to SEQ ID NO: 13820

SEQ ID NO: 16771 - protein, 111 aa, Artificial Sequence
  Description of Artificial Sequence: Synthetic polypeptide
  Synthetic Humanized 1277 VL polypeptide
  MOD_RES (13)..(13): Ala or Val
  MOD_RES (19)..(19): Val or Ala
  MOD_RES (33)..(34): Any naturally occurring amino acid
  MOD_RES (42)..(42): Gln or Leu
  MOD_RES (48)..(48): Ala or Ser
  MOD_RES (83)..(83): Leu or Val
  MOD_RES (89)..(89): Ala or Gly
  MOD_RES (92)..(92): Tyr or Phe
  MOD_RES (108)..(108): Val or Leu
DIQMTQSPSSLSXSVGDRXTITCRSSQSLVHSXXNTYLHWYXQKPGKXPKLLIYKVSNRFSGVPSRFSGSGSGTDFTLTISSXQPEDFXTYXCSQSTHVPTFGGGTKXEIK

SEQ ID NO: 16772 - protein, 220 aa, Homo sapiens; identical to SEQ ID NO: 13821

SEQ ID NO: 16773 - protein, 216 aa, Homo sapiens; identical to SEQ ID NO: 13822

SEQ ID NO: 16774 - protein, 216 aa, Homo sapiens; identical to SEQ ID NO: 13823

SEQ ID NO: 16775 - protein, 216 aa, Homo sapiens; identical to SEQ ID NO: 13824

SEQ ID NO: 16776 - protein, 217 aa, Homo sapiens; identical to SEQ ID NO: 13825

SEQ ID NO: 16777 - protein, 107 aa, Artificial Sequence
  Description of Artificial Sequence: Synthetic polypeptide
  Synthetic Humanized 1565 VL polypeptide
  MOD_RES (4)..(4): Leu or Met
  MOD_RES (75)..(75): Ile or Val
  MOD_RES (87)..(87): Tyr or Phe
AIQXTQSPSSLSASVGDRVTITCKASQDVDTAVAWYQQKPGKAPKLLIYWASTRHTGVPSRFSGSGSGTDFTLTXSSLQPEDFATYXCQQYSSYPLTFGGGTKVEIK

SEQ ID NO: 16778 - protein, 111 aa, Artificial Sequence
  Description of Artificial Sequence: Synthetic polypeptide
DIQMTQSPSSLSASVGDRATITCRSSQSLVHSNGNTYLHWYQQKPGKAPKLLIYKVSNRFSGVPSRFSGSGSGTDFTLTISSLQPEDFATYFCSQSTHVPTFGGGTKVEIK

SEQ ID NO: 16779 - protein, 111 aa, Artificial Sequence
  Description of Artificial Sequence: Synthetic polypeptide
DVVMTQSPLSLPVTLGQPASISCRSSQSLVHSNGNTYLHWYQQRPGQSPRLLIYKVSNRFSGVPDRFSGSGSGTDFTLKISRVEAEDVGVYFCSQSTHVPTFGGGTKLEIK

SEQ ID NO: 16780 - protein, 111 aa, Artificial Sequence
  Description of Artificial Sequence: Synthetic polypeptide
DVVMTQSPLSLPVTLGQPASISCRSSQSLVHSNLNTYLHWYQQRPGQSPRLLIYKVSNRFSGVPDRFSGSGSGTDFTLKISRVEAEDVGVYFCSQSTHVPTFGGGTKVEIK

SEQ ID NO: 16781 - protein, 107 aa, Artificial Sequence
  Description of Artificial Sequence: Synthetic polypeptide
AIQLTQSPSSLSASVGDRVTITCKASQDVDTAVAWYQQKPGKAPKLLIYWASTRHTGVPSRFSGSGSGTDFTLTVSSLQPEDFATYFCQQYSSYPLTFGGGTKVEIK

SEQ ID NO: 16782 - protein, 107 aa, Homo Sapiens
EIVLTQSPGTLSLSPGERATLSCRASQSISSSYLAWYQQKPGQAPRLLIYGPSSRATGIPDRFSGSGSGTDFTLTISRLEPEDFAVYYCQQYAGSLTFGPGTKVDIK

SEQ ID NO: 16783 - protein, 111 aa, Artificial Sequence
  Description of Artificial Sequence: Synthetic polypeptide
  Synthetic Humanized 1277A VL polypeptide
  MOD_RES (33)..(33): Asn or Ser
  MOD_RES (34)..(34): Gly or Leu
  MOD_RES (41)..(41): Phe or Tyr
  MOD_RES (42)..(42): Gln or Leu
  MOD_RES (51)..(51): Arg or Leu
  MOD_RES (92)..(92): Tyr or Phe
DVVMTQSPLSLPVTLGQPASISCRSSQSLVHSXXNTYLHWXXQRPGQSPRXLIYKVSNRFSGVPDRFSGSGSGTDFTLKISRVEAEDVGVYXCSQSTHVPTFGGGTKVEIK

SEQ ID NO: 16784 - protein, 114 aa, Artificial Sequence
  Description of Artificial Sequence: Synthetic polypeptide
  Synthetic construct - Synthetic peptide
QSVLTQPPSASGTPGQGVTISCSGSSADIGANYVYWYQQLPGTAPKLLIYSINQRPSGVPDRFSGSKSGTSASLAISGLRSEDEADYYCATWDDSLGGWAFGGGTKVEIKRTVA

SEQ ID NO: 16785 - protein, 107 aa, Mus musculus
DIQMTQSPASLSASVGETVTITCRTSENIYIYLAWYQQKQGKSPQLLVYNAKTLAEGVPSRFSGSGSGTQFSLKINGLQPEDFGGYYCQQHYGTPYTFGGGTKLEKK

SEQ ID NO: 16786 - protein, 107 aa, Homo Sapiens [sequence omitted]

SEQ ID NO: 16787 - protein, 107 aa, Homo Sapiens [sequence omitted]

SEQ ID NO: 16788 - protein, 107 aa, Artificial Sequence
  Description of Artificial Sequence: Synthetic polypeptide
  huEGFR-8 VL
DIVLTQSPAFMSASPGEKVTMTCSASSSVSYMHWYQQKPDQSPKRWIYATSKLASGVPSRFSGSGSGTDYSLTISSMEAEDAATYYCQQWSSNPLTFGQGTKLELKR

SEQ ID NO: 16789 - protein, 109 aa, Artificial Sequence; identical to SEQ ID NO: 13800
  Description of Artificial Sequence: Synthetic polypeptide
  Synthetic light chain variable region construct

SEQ ID NO: 16790 - protein, 109 aa, Artificial Sequence; identical to SEQ ID NO: 13801
  Description of Artificial Sequence: Synthetic polypeptide
  Synthetic light chain variable region construct

SEQ ID NO: 16791 - protein, 107 aa, Artificial Sequence
  Description of Artificial Sequence: Synthetic polypeptide
  huML66 VL
DTVLTQSPSLAVSPGERATISCRASESVSTLMHWYQQKPGQQPKLLIYLASHRESGVPARFSGSGSGTDFTLTIDPMEAEDTATYYCQQSRNDPWTFGQGTKLELKR

SEQ ID NO: 16792 - protein, 108 aa, Rattus sp.; identical to SEQ ID NO: 13195
  ICR62 VL

SEQ ID NO: 16793 - protein, 111 aa, Artificial Sequence
  Description of Artificial Sequence: Synthetic polypeptide
  Synthetic construct - Synthetic peptide
DIVLTQSPATLSLSPGERATLSCRASQSVSSYLAWFQQKPGQAPRLLIYDASNRATGVPARFSGSGSGTDFTLTITSLEPEDFAVYYCQQRGDWPLTFGGGTKVEIKRTVA

SEQ ID NO: 16794 - protein, 108 aa, Mus musculus; identical to SEQ ID NO: 13192

SEQ ID NO: 16795 - protein, 107 aa, Mus musculus; identical to SEQ ID NO: 13193

SEQ ID NO: 16796 - protein, 107 aa, Artificial Sequence
  Description of Artificial Sequence: Synthetic polypeptide
  muEGFR-8 VL
QIVLTQSPASMSASPGEKVTMTCSASSSVSYMHWYQQKSGTSPKRWIYATSKLASGVPARFSGSGSGTSYSLTISSMEAEDAATYYCQQWSSNPLTFGAGTKLELKR

SEQ ID NO: 16797 - protein, 127 aa, Artificial Sequence; identical to SEQ ID NO: 13851
  Description of Artificial Sequence: Synthetic polypeptide

SEQ ID NO: 16798 - protein, 133 aa, Artificial Sequence; identical to SEQ ID NO: 13852
  Description of Artificial Sequence: Synthetic polypeptide

SEQ ID NO: 16799 - protein, 128 aa, Artificial Sequence; identical to SEQ ID NO: 13853
  Description of Artificial Sequence: Synthetic polypeptide

SEQ ID NO: 16800 - protein, 107 aa, Artificial Sequence
  Description of Artificial Sequence: Synthetic polypeptide
  ratML66 VL
DTVLTQSPALAVSPGERVTISCRASESVSTLMHWYQQKSGQQPKLLIYLASHRESGVPARFSGSGSGTDFTLTIDPMEADDTATYYCQQSRNDPWTFGGGTNLELKR

SEQ ID NO: 16801 - protein, 127 aa, Artificial Sequence; identical to SEQ ID NO: 13189
  Description of Artificial Sequence: Synthetic polypeptide

SEQ ID NO: 16802 - protein, 108 aa, Artificial Sequence; identical to SEQ ID NO: 8767
  Description of Artificial Sequence: Synthetic polypeptide
  anti-EGFR VL

SEQ ID NO: 16803 - protein, 128 aa, Mus musculus; identical to SEQ ID NO: 12652

SEQ ID NO: 16804 - protein, 108 aa, Mus musculus; identical to SEQ ID NO: 13191

SEQ ID NO: 16805 - protein, 117 aa, Artificial Sequence
  Description of Artificial Sequence: Synthetic polypeptide
  Synthetic construct - Synthetic peptide
DIVMTQTPDSLAVSLGERATINCKSSQNLLYTSSNQTYLAWYQQKPGQPPKLLIYWASTRESGVPDRFSGSGSGTDFTLTISSLQPEDVAAYYCQQYYRTPITFGPGTKVEIKRTVA

SEQ ID NO: 16806 - protein, 115 aa, Artificial Sequence
  Description of Artificial Sequence: Synthetic polypeptide
  Synthetic construct - Synthetic peptide
EIVMTQSPCPSPLESRPPSPAGLVRASWIAMMATPIWTGTCRSQGSLHSSSIYTLSHRAPGVPDRFSGSGSGTDFTLKISRVEAEDVGVYYCLQRIDFPFTFGPGTKVEIKRTVA

SEQ ID NO: 16807 - protein, 139 aa, Mus musculus
MVLAQFLAFLLLWFPGARCDILMTQSPSSMSVSLGDTVSITCHASQDINSNIGWLQQKPGKSFKGLIYHGTNLEDGVPSRFSGSGSGADYSLTISSLESEDFADYYCVQYAQFPWTFGGGTKLEIKRADAAPTVSIFPP

SEQ ID NO: 16808 - protein, 108 aa, Homo sapiens
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIKR

SEQ ID NO: 16809 - protein, 108 aa, Mus sp.
DIQLTQSHKFMSTSVGDRVSITCKASQDVSIAVAWYQQKPGQSPKLLIYSASYRYTGVPDRFTGSGSGTDFTFTISSVQAEDLAVYYCQQHYITPLTFGAGTKLELKR

SEQ ID NO: 16810 - protein, 107 aa, Artificial Sequence
  Description of Artificial Sequence: Synthetic polypeptide
  anti-endoglin single variable domain light chain (clone Kro23) VL
QIVLTQSPALMSASPGEKVTMTCSASSSVSYMYWYQQRPRSSPKPWIYLTSNLASGVPARFSGSGSGTSYSLTISSMEAEDAATYYCQQWSSNPLTFGAGTKLELKR

SEQ ID NO: 16811 - protein, 107 aa, Artificial Sequence
  Description of Artificial Sequence: Synthetic polypeptide
  Synthetic 3-1 VL
ELVMTQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIK

SEQ ID NO: 16812 - protein, 112 aa, Artificial Sequence
  Description of Artificial Sequence: Synthetic polypeptide
  Synthetic 4-7 VL
ELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 16813 - protein, 113 aa, Artificial Sequence
  Description of Artificial Sequence: Synthetic polypeptide
  Synthetic 5-10 VL
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 16814 - protein, 110 aa, Homo sapiens; identical to SEQ ID NO: 14067
  VL domain

SEQ ID NO: 16815 - protein, 112 aa, Artificial Sequence
  Description of Artificial Sequence: Synthetic polypeptide
DVLMTQIPLSLPVSLGDQASISCRSSQSIVHSNGNTYLEWYLQKPGQSPKSLIYKVSNRFSGVPDRFSGSGSGTDFTLKISRVEAEDLGVYYCFQGSYVPWTFGGGTKLEIK

SEQ ID NO: 16816 - protein, 112 aa, Artificial Sequence
  Description of Artificial Sequence: Synthetic polypeptide
DIVLTQTAPSVPVTPGESVSISCRSSKSLLHSNGNTYLYWFLQRPGQSPQLLIYRMSNLASGVPDRFSGSGSGTAFTLRISRVEAEDVGVYYCMQHLEYPFTFGSGTKLEIK

SEQ ID NO: 16817 - protein, 112 aa, Artificial Sequence
  Description of Artificial Sequence: Synthetic polypeptide
DVLMTQTPLSLPVSLGDQASISCRSSQSIVHSIGNTYLEWYLQKPGQSPKLLIYKVSNRFSGVPERFSGSGSGTDFTLKISRVEAEDLGVYYCFQGSHVPFTFGSGTKLEIK

SEQ ID NO: 16818 - protein, 112 aa, Artificial Sequence
  Description of Artificial Sequence: Synthetic polypeptide
DVLMTQIPLSLPVSLGDQASISCRSSQSIVHSNGNTYLEWYLQKPGQSPKLLIYKVSNRFSGVPDRFSGSGSGTDFTLKISRVEAEDLGVYYCFQGSYVPWTFGGGTKLEIK

SEQ ID NO: 16819 - protein, 107 aa, Artificial Sequence
  Description of Artificial Sequence: Synthetic polypeptide
ETTVTQSPASLSMAIGDKVTIRCITSTDIDDDMNWFQQKPGEPPKLLISEGNTLRPGVPSRFSGSGYGTDFIFTIENMLSEDVADYYCLQSDNLPYTFGGGTKLEIK

SEQ ID NO: 16820 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSYVPWTFGGGTKLEIK

SEQ ID NO: 16821 - protein, 107 aa, Artificial Sequence
  Description of Artificial Sequence: Synthetic polypeptide
DIQMTQSPSSLSASLGERVSLTCRASQEISGYLSWLQQKPDGTIKRLIYAASTLDSGVPKRFSGSRSGSDYSLTIGSLESEDLADYYCLQYDSYPYTFGGGTKLEIK

SEQ ID NO: 16822 - protein, 107 aa, Artificial Sequence
  Description of Artificial Sequence: Synthetic polypeptide
DIQMTQSPSSLSASVGDRVTITCRASQEISGYLSWLQQKPGGAIKRLIYAASTLDSGVPSRFSGSGSGSDYTLTISSLQPEDFATYYCLQYDSYPYTFGQGTKLEIK

SEQ ID NO: 16823 - protein, 111 aa, Artificial Sequence [sequence omitted]

SEQ ID NO: 16824 - protein, 107 aa, Artificial Sequence
  Description of Artificial Sequence: Synthetic polypeptide
DIQMTQSPSSLSASVGDRVTITCRASQEISGYLSWFQQKPGKAPKSLIYAASTLDSGVPSRFSGSGSGTDFTLTISSLQPEDFATYYCLQYDSYPYTFGQGTKLEIK

SEQ ID NO: 16825 - protein, 107 aa, Artificial Sequence
  Description of Artificial Sequence: Synthetic polypeptide
DIQMTQSPSSLSASVGDRVTITCRASQEISGYLSWYQQKPGKAPKRLIYAASTLDSGVPSRFSGSGSGTEFTLTISSLQPEDFATYYCLQYDSYPYTFGQGTKLEIK

SEQ ID NO: 16826 - protein, 107 aa, Artificial Sequence
  Description of Artificial Sequence: Synthetic polypeptide
DIQMTQSPSSLSASVGDRVTITCRASQEISGYLSWYQQKPGKAPKLLIYAASTLDSGVPSRFSGSGSGTDFTFTISSLQPEDIATYYCLQYDSYPYTFGQGTKLEIK

SEQ ID NO: 16827 - protein, 107 aa, Artificial Sequence
  Description of Artificial Sequence: Synthetic polypeptide
DIQMTQSPSSLSASVGDRVTITCRASQEISGYLSWYQQKPGKAPKLLIYAASTLDSGVPSRFSGSGSGTDFTLTISSLQPEDFATYYCLQYDSYPYTFGQGTKLEIK

SEQ ID NO: 16828 - protein, 107 aa, Artificial Sequence
  Description of Artificial Sequence: Synthetic polypeptide
DIQLTQSPSFLSASVGDRVTITCRASQEISGYLSWYQQKPGKAPKLLIYAASTLDSGVPSRFSGSGSGTEFTLTISSLQPEDFATYYCLQYDSYPYTFGQGTKLEIK

SEQ ID NO: 16829 - protein, 108 aa, Artificial Sequence
  Description of Artificial Sequence: Synthetic polypeptide
AIQMTQSPSSLSASVGDRVTITCRASQDIRDDLGWFQQKPGKAPNLLIYAASSLQSGVPSRFSGSGSGTDFTLTISSLQPEDFATYYCLQDYNYPLTFGGGTKVEIKR

SEQ ID NO: 16830 - protein, 108 aa, Artificial Sequence
  Description of Artificial Sequence: Synthetic polypeptide
DIQLTQSPSFLSASVGDRVTITCWASQDISSYLAWYQQKPGKAPKLLIYAASTFQSGVPSRFSGSGSGTEFTLTISNLQPEDFATYYCQQLDSYPLSFGGGTKVEIKR

SEQ ID NO: 16831 - protein, 108 aa, Artificial Sequence
  Description of Artificial Sequence: Synthetic polypeptide
DIQLTQSPSFLSASVGDRVTITCWASQGISDYLAWYQKKPGKAPQLLIYAATTLQSGVPSRFSGSGSGTEFTLTISSLQPEDFATYYCQQLNTYPLTFGGGTKVEIKR

SEQ ID NO: 16832 - protein, 108 aa, Artificial Sequence
  Description of Artificial Sequence: Synthetic polypeptide
DIQLTQSPSFLSASVGDRVTITCWASQGISSFLAWYQQKAGKAPRLLIYAASTLQTGVPSRFSGSGSGTEFTLTISSLQPGDFATYHCQQLNSYPYTFGQGTKLEIKR

SEQ ID NO: 16833 - protein, 108 aa, Artificial Sequence
  Description of Artificial Sequence: Synthetic polypeptide
DIQLTQSPSFLSASVGDRVTITCWASQDITSYLAWYQKKPGKAPKLLIYAASTLQSGVPSRFSGSGSGTEFTLTISSLQPEDFAAYYCQQLNSYPLTFGGGTKVDIKR

SEQ ID NO: 16834 - protein, 108 aa, Artificial Sequence
  Description of Artificial Sequence: Synthetic polypeptide
DIQMTQSPSSVSASVGDRVTITCRASQGISDYLAWYQQKPGKAPKLLIYAASSLQSGVPSRFSGRGSGTDFTLTISTLQPEDFATYYCQQANSFPLTFGGGTKVDIKR

SEQ ID NO: 16835 - protein, 108 aa, Artificial Sequence
  Description of Artificial Sequence: Synthetic polypeptide
DIQLTQSPSFLSASVGDRVTITCWASQGISSYLAWYQQKPGKAPKLLIYGASTLQSGVPSRFSGSGSGTEFTLTISSLQPEDFATYYCQQLNSYPLTFGGGTKVEIKR

SEQ ID NO: 16836 - protein, 108 aa, Artificial Sequence
  Description of Artificial Sequence: Synthetic polypeptide
AIQMTQSPSSLSASVGDRVTITCRASQGIRNDLGWYQQKPGKAPKVLIYAASSLQSGVPSRFSGSGSGTVFTLTISSLQPEDFATYYCLQDYNYPLTFGGGTKVEIKR

SEQ ID NO: 16837 - protein, 114 aa, Artificial Sequence
  Description of Artificial Sequence: Synthetic polypeptide
DIVMTQSPDSLAVSLGERATINCKSSQSVLSSSNDNNYLAWFQQKPGQPPNLLIYWASTRDSGVPDRFSASGSGTDFTLAISSLQAEDVAVYYCHQYYSSPPTFGQGTKVEIKR

SEQ ID NO: 16838 - protein, 107 aa, Artificial Sequence
  Description of Artificial Sequence: Synthetic polypeptide
DIVMTQSPSSVSASVGDRVTITCRASQGVSSWLAWYQQKPGKAPKLLIYTTSSLQSGVPSRFSGSGSGTDFTLTISSLQPEDFATYYCQQSNSFPFTFGPGTKVEIK

SEQ ID NO: 16839 - protein, 108 aa, Artificial Sequence
  Description of Artificial Sequence: Synthetic polypeptide
DIQLTQSPSFLSASVGDRVTITCWASQDISSYLAWYQQKPGKAPKLLIYAASTLQSGVPSRFSGSGSGTEFTLTISSLQPEDFATYYCQQLNSYPLTFGGGTKVEIKR

SEQ ID NO: 16840 - protein, 108 aa, Artificial Sequence
  Description of Artificial Sequence: Synthetic polypeptide
DVVMTQSPSFLSASVGDRVTITCWASQGISSYLAWYQQKPGKAPKLLIYDASTLESGVPSRFSGSGSGTEFTLTISNLQPEDFATYYCQQVNSYPLTFGGGTKVEIKR

SEQ ID NO: 16841 - protein, 113 aa, Artificial Sequence
  Description of Artificial Sequence: Synthetic polypeptide
DIQMTQSPDSLAVSLGERAAINCKSSQSVLYISNNNNYLAWYQQKPGQPPKLLIYWASTRESGVPDRFSGSGSGTDFTLTISSLQAEDVAIYYCQQYYSSPPTFGQGTKVDIK

SEQ ID NO: 16842 - protein, 108 aa, Artificial Sequence
  Description of Artificial Sequence: Synthetic polypeptide
DIQLTQSPSFLSASVGDRVTITCWASQDISSYLAWYQQKPGKAPKLLIYGASTLESGVPSRFSGSGSGTEFTLTISSLQPEDVATYYCQQLNTYPLTFGGGTKVEIKR

SEQ ID NO: 16843 - protein, 108 aa, Artificial Sequence
  Description of Artificial Sequence: Synthetic polypeptide
DIQMTQSPSSVSASVGDRVTITCRASQDINSWLAWYQQKPGKAPKLLIYTSSNLQSGVPSRFSGSGSGTDFTLTISSLQPEDFATYYCQQSDSFPFTFGPGTKVDIKR

SEQ ID NO: 16844 - protein, 107 aa, Artificial Sequence
  Description of Artificial Sequence: Synthetic polypeptide
DIVMTQSPSSLSASVGDRVTITCRASQDIRNDLGWYQQKPGKAPKLLIYAASSLQTGVPSRFSGSVSGTDFTLTISSLQPEDFATYYCLQDYTYPLTFGGGTKVEIK

SEQ ID NO: 16845 - protein, 114 aa, Artificial Sequence
  Description of Artificial Sequence: Synthetic polypeptide
DIVMTQSPDSLDVPLGERATINCKSSQSILFGSNNKNYLAWYQQKSGQPPKLLIYWASTRESGVPDRFSGSGSGTDFTLTISSLQAEDVAVYYCQQYYSTPHTFGQGTKVEIKR

SEQ ID NO: 16846 - protein, 108 aa, Artificial Sequence
  Description of Artificial Sequence: Synthetic polypeptide
DIQMTQSPSSVSASVGDRVTITCRASQDISSWLAWYQQKPGRAPKLLIYTASSLQSGVPSRFSGSGSGTDFTLTISSLQPEDFATYFCQQANSFPFTFGPGTKVDIKR

SEQ ID NO: 16847 - protein, 107 aa, Artificial Sequence
  Description of Artificial Sequence: Synthetic polypeptide
DIQLTQSPSFLSASVGDRVTITCWASQDISSYLAWYQQKPGKVPNLLIYGASSLQPGVPSRFSGSGSGTEFTLTISSLQPEDFATYYCQQLNNYPTFGGGTKLEIKR

SEQ ID NO: 16848 - protein, 107 aa, Artificial Sequence
  Description of Artificial Sequence: Synthetic polypeptide
DIQMTQSPSSLSASVGDRVTITCRASQDISSYLAWYQQKPGKVPNLLIYDASSLQSGVPSRFSGSGSGTDFTLTLSSLQPEDFASYYCQNYNSAPYTFGQGTKLEIK

SEQ ID NO: 16849 - protein, 113 aa, Artificial Sequence
  Description of Artificial Sequence: Synthetic polypeptide
DIVMTQSPDSLAVSLGERATINCKSSQSVLYNSDNKKYLAWYQQKPGQPPKLLIYWASTRESGVPDRFSGSGSGTDFTLTISSLQAEDVAVYYCHQYYTTPPTFGQGTKVEIK

SEQ ID NO: 16850 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYFCQEYNDWPLTFGGGTKVEIK

SEQ ID NO: 16851 - protein, 107 aa, Artificial Sequence
  Description of Artificial Sequence: Synthetic polypeptide
EILMTQSPATLSVSPGERATLSCRASQSVSSNLAWYQQKPGQAPRLLIYGASTRATGIPARFSGSGSGTEFTLTISSLQSEDFAIYYCQEYNDWPLTFGGGTKVEIK

SEQ ID NO: 16852 - protein, 107 aa, Artificial Sequence
  Description of Artificial Sequence: Synthetic polypeptide
DIQMTQSPSSVSASVGDRVTITCRASQDISSWLAWYQQKPGTAPKFLIYETSSLQSGVPSRFSGSGSGTDFILTISSLQPEDFATYYCQQTDSFPHTFGQGTKLEIR

SEQ ID NO: 16853 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGTSSRATGIPDRFSGSGSGTDFTLTISRLEPEDFAVYYCQQYDNSYTFGQGTKLEIK

SEQ ID NO: 16854 - protein, 107 aa, Artificial Sequence
  Description of Artificial Sequence: Synthetic polypeptide
EIVLTQSPDTLSLSPGERATLSCRASQSVSSNYLAWYQQKPGQAPRLLIYSASNRATGIPDRFSGSGSGTDFTLTISRLEPEDFAVYYCQQYDSSYTFGQGTKLEIK

SEQ ID NO: 16855 - protein, 107 aa, Artificial Sequence
  Description of Artificial Sequence: Synthetic polypeptide
DIQMTQSPSSLSASVGDRVTVTCRASQGISNYLAWYQQKPGKVPKLLIYAASTLQSGVPSRFSGSGSGTDFTLTISSLQPEDVASYYCQNYNSAPMTFGQGTKVEIK

SEQ ID NO: 16856 - protein, 107 aa, Artificial Sequence
  Description of Artificial Sequence: Synthetic polypeptide
DIQMTQSPSSLSASVGDRVTITCRASQVIRNDLGWFQQRPGKAPKRLIYAASSLQSEVPSRFSGSGSGTEFTLTITSLQPEDFATYYCLQHNSYPLTFGQGTRLEIK

SEQ ID NO: 16857 - protein, 106 aa, Artificial Sequence
  Description of Artificial Sequence: Synthetic polypeptide
QIVMTQSPATLSVSPGERATLSCRASQSITPYLAWYQQKPGQTPRLLIYGVSTRATGIPARFSGSGSGTEFTLTISSLQSEDFAVYYCQQYDNWYTFGQGTKLEIK

SEQ ID NO: 16858 - protein, 107 aa, Artificial Sequence
  Description of Artificial Sequence: Synthetic polypeptide
AIQMTQSPSSLSASVGDRVTITCRASQDIRNDLGWYQQKPGKAPNLLIYAASSLQSGVPSRFSGSGSGTDFTLTISSLQPEDFATYYCLQDSNYPLTFGGGTKVEIK

SEQ ID NO: 16859 - protein, 109 aa, Artificial Sequence
  Description of Artificial Sequence: Synthetic polypeptide
  Synthetic consensus sequence
  MOD_RES (2)..(2): Ser or Tyr
  MOD_RES (65)..(65): Ser or Thr
  MOD_RES (69)..(69): Ser or Thr
  MOD_RES (88)..(88): Asn, Glu or Met
  MOD_RES (92)..(92): Trp, Val, Thr, Ser, His, Tyr, Asn or Ala
  MOD_RES (93)..(93): Ser or Pro
  MOD_RES (95)..(95): Asn or Asp
  MOD_RES (96)..(96): Gln, Lys, His, Ser, Val, Arg, Thr or Asn
  MOD_RES (108)..(108): Leu or Ile
SXELTQDPAVSVALGQTVRITCQGDSLRSYYASWYQQKPGQAPVLVIYGKNNRPSGIPDRFSGSXSGNXASLTITGAQAEDEADYYCXSRDXXGXXWVFGGGTKVTVXG

SEQ ID NO: 16860 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDWPGNQWVFGGGTKVTVLG

SEQ ID NO: 16861 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDVPGDQWVFGGGTKVTVLG

SEQ ID NO: 16862 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 16863 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVIG

SEQ ID NO: 16864 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 16865 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 16866 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 16867 - protein, 109 aa, Artificial Sequence
  Description of Artificial Sequence: Synthetic polypeptide
SYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 16868 - protein, 109 aa, Artificial Sequence
  Description of Artificial Sequence: Synthetic polypeptide
SYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 16869 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGNSWVFGGGTKVTVLG

SEQ ID NO: 16870 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDSPGNVWVFGGGTKVTVLG

SEQ ID NO: 16871 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGNRWVFGGGTKVTVLG

SEQ ID NO: 16872 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNTWVFGGGTKVTVLG

SEQ ID NO: 16873 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDTPGNKWVFGGGTKVTVLG

SEQ ID NO: 16874 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDVPGNQWVFGGGTKVTVLG

SEQ ID NO: 16875 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDNPGNQWVFGGGTKVTVLG

SEQ ID NO: 16876 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDHPGNNWVFGGGTKVTVLG

SEQ ID NO: 16877 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGNQWVFGGGTKVTVIG

SEQ ID NO: 16878 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGDKWVFGGGTKVTVLG

SEQ ID NO: 16879 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGDQWVFGGGTKVTVLG

SEQ ID NO: 16880 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDYPGNNWVFGGGTKVTVLG

SEQ ID NO: 16881 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCMSRDYPGNHWVFGGGTKVTVLG

SEQ ID NO: 16882 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCESRDAPGDQWVFGGGTKVTVLG

SEQ ID NO: 16883 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGNQWVFGGGTKVTVLG

SEQ ID NO: 16884 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSPGNNWVFGGGTKVTVLG

SEQ ID NO: 16885 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDYPGNNWVFGGGTKVTVLG

SEQ ID NO: 16886 - protein, 108 aa, Artificial Sequence
  Description of Artificial Sequence: Synthetic polypeptide
  13E8; 17A11; VL
EIVLTQSPGTLSLSPGERATLSCRASQSVSSSYLAWYQQKPGQAPRLLIYGASSRATGIPDRFSGSGSGTDFTLTISRLEPEDFAVYYCQQGLNIPSTFGQGTKVEIK

SEQ ID NO: 16887 - protein, 108 aa, Artificial Sequence
  Description of Artificial Sequence: Synthetic polypeptide
  14C10; VL
EIVLTQSPGTLSLSPGERATLSCRASQSVSSSYLAWYQQKPGQAPRLLIYGASSRATGIPDRFSGSGSGTDFTLTISRLEPEDFAVYYCQQGHIIPPTFGQGTKVEIK

SEQ ID NO: 16888 - protein, 108 aa, Artificial Sequence
  Description of Artificial Sequence: Synthetic polypeptide
  2C4; VL
EIVLTQSPGTLSLSPGERATLSCRASQSVSSNYLAWYQQKPGQAPRLLIYGASIRATGIPDRFSGSGSGTDFTLTISRLEPEDFAVYYCQQGNQIPPTFGQGTKVEIK

SEQ ID NO: 16889 - protein, 108 aa, Artificial Sequence
  Description of Artificial Sequence: Synthetic polypeptide
  2C6; 7A1; VL
EIVLTQSPGTLSLSPGERATLSCRASQSVSSSYLAWYQQKPGQAPRLLIYGASSRATGIPDRFSGSGSGTDFTLTISRLEPEDFAVYYCQQGQQIPPTFGQGTKVEIK

SEQ ID NO: 16890 - protein, 108 aa, Artificial Sequence
  Description of Artificial Sequence: Synthetic polypeptide
  3D9; 13C2; VL
EIVLTQSPGTLSLSPGERATLSCRASQSVSSSYLAWYQQKPGQAPRLLIYGASSRATGIPDRFSGSGSGTDFTLTISRLEPEDFAVYYCQQGQLIPPTFGQGTKVEIK

SEQ ID NO: 16891 - protein, 108 aa, Artificial Sequence
  Description of Artificial Sequence: Synthetic polypeptide
  3F2; VL
EIVLTQSPGTLSLYPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 16892 - protein, 108 aa, Artificial Sequence
  Description of Artificial Sequence: Synthetic polypeptide
  3F2(YS); 19G1; 20G8; 4B9; 5B8; 5F1; 14B3; 16F1; 16F8; O3C9; 22A3; 29B11; VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 16893 - protein, 108 aa, Artificial Sequence
  Description of Artificial Sequence: Synthetic polypeptide
  4B3; VL
EIVLTQSPGTLSLSPGERATLSCRASQSVSSNYLAWYQQKPGQAPRLLIYGAYIRATGIPDRFSGSGSGTDFTLTISRLEPEDFAVYYCQQGQVIPPTFGQGTKVEIK

SEQ ID NO: 16894 - protein, 108 aa, Artificial Sequence
  Description of Artificial Sequence: Synthetic polypeptide
  4B8; VL
EIVLTQSPGTLSLSPGERATLSCRASQSVSSSYLAWYQQKPGQAPRLLIYGASSRATGIPDRFSGSGSGTDFTLTISRLEPEDFAVYYCQQGQVIPPTFGQGTKVEIK

SEQ ID NO: 16895 - protein, 108 aa, Artificial Sequence
  Description of Artificial Sequence: Synthetic polypeptide
  4D6; VL
EIVLTQSPGTLSLSPGERATLSCRASQSVSSNYLAWYQQKPGQAPRLLIQGASSRATGIPDRFSGSGSGTDFTLTISRLEPEDFAVYYCQQGQVIPPTFGQGTKVEIK

SEQ ID NO: 16896 - protein, 108 aa, Artificial Sequence
  Description of Artificial Sequence: Synthetic polypeptide
  4G8; 28H1; 23C10; VL
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 16897 - protein, 108 aa, Artificial Sequence
  Description of Artificial Sequence: Synthetic polypeptide
  5H5; 2D9; VL
EIVLTQSPGTLSLSPGERATLSCRASQSVSSSYLAWYQQKPGQAPRLLIYGASSRATGIPDRFSGSGSGTDFTLTISRLEPEDFAVYYCQQGNQIPPTFGQGTKVEIK

SEQ ID NO: 16898 - protein, 108 aa, Artificial Sequence
  Description of Artificial Sequence: Synthetic polypeptide
  VL of antibody F5 specific for fibroblast activation protein (FAP)
EIVLTQSPGTLSLSPGERATLSCRASQSVSRNYLAWYQQKPGQAPRLLIYGASSRATGIPDRFSGSGSGTDFTLTISRLEPEDFAVYYCQQSLGYPPTFGQGTKVEIK

SEQ ID NO: 16899 - protein, 112 aa, Artificial Sequence
  Description of Artificial Sequence: Synthetic polypeptide
  Synthetic sequence: hu36-VL
DIQMTQSPSSLSASVGDRVTITCRASKSVSTSAYSYMHWYQQKPGKAPKLLIYLASNLESGVPSRFSGSGSGTDFTLTISSLQPEDFATYYCQHSRELPYTFGQGTKLEIKR

SEQ ID NO: 16900 - protein, 108 aa, Artificial Sequence
  Description of Artificial Sequence: Synthetic polypeptide
  O2D7; VL
EIVLTQSPGTLSLSPGERATLSCRASQSVTSSYLAWYQQKPGQAPRLLINVGSRRATGTPDRFSGSGSGTDFTLTISRLEPEDFAVYYCQQAIMLPPTFGQGTKVEIK

SEQ ID NO: 16901 - protein, 107 aa, Homo sapiens
ETTLTQSPGTLSLSPGERATLSCRASQTVTRNYLAWYQQKPGQAPRLLMYGASNRAAGVPDRFSGSGSGTDFTLTISRLEPEDFAVYYCQQFGSPYTFGQGTKVEIK

SEQ ID NO: 16902 - protein, 112 aa, Homo sapiens
DVVMTQSPLSLPVTLGQPASISCRSSQSLLHSNGYNYLDWYLQRPGQSPHLLIFLGSNRASGVPDRFSGSGSGTDFTLKISRVEAEDVGIYYCMQALQTPPTFGQGTKVEIK

SEQ ID NO: 16903 - protein, 133 aa, Homo sapiens
MDSQAQVLMLLPLWVSGTCGDIVMSQSPSSLAVSVGEKVTMSCKSSQSLLYSRNQKNYLAWFQQKPGQSPKLLIFWASTRESGVPDRFTGSGFGTDFNLTISSVQAEDLAVYDCQQYFSYPLTFGAGTKLELK

SEQ ID NO: 16904 - protein, 113 aa, Homo sapiens; identical to SEQ ID NO: 8074

SEQ ID NO: 16905 - protein, 113 aa, Homo sapiens
DIVMTQSPDSLAVSLGERATINCKSSQSLLYSRNQKNYLAWFQQKPGQPPKLLIFWASTRESGVPDRFSGSGFGTDFTLTISSLQAEDVAVYDCQQYFSYPLTFGQGTKVEIK

SEQ ID NO: 16906 - protein, 113 aa, Homo sapiens; identical to SEQ ID NO: 8076

SEQ ID NO: 16907 - protein, 118 aa, Homo sapiens
DIQMTQSPSSLSASTGDRVTITCRASQDISSYLAWYQQAPGKAPHLLMSGATTLQTGVPSRFSGSGSGTDFTLTITSLQSEDFATYYCQQYYIYPPTFGQGTRVEIKRTVAAPSVFAA

SEQ ID NO: 16908 - protein, 118 aa, Artificial Sequence
  Description of Artificial Sequence: Synthetic polypeptide
  Humanised Antibody
DIQMTQSPSSLSASTGDRVTITCRASQDISSYLAWYQQAPGKAPHLLMSGATTLQTGVPSRFSGSGSGTDFTLTISSLQAEDVAVYYCQQYYRTPFTFGQGTKLEIKRTVAAPSVFAA

SEQ ID NO: 16909 - protein, 137 aa, Mus musculus
MDFQVQIFSFLLISASVIISRGQIVLTQSPAIMSASPGEKVTMTCSASSGVNFMHWYQQKSGTSPKRWIFDTSKLASGVPARFSGSGSGTSYSLTISSMEAEDAATYYCQQWSFNPPTFGGGTKLEIKRADAAPTVS

SEQ ID NO: 16910 - protein, 107 aa, Artificial Sequence
  Description of Artificial Sequence: Synthetic polypeptide
  Humanized mouse sequence
QIVLTQSPATLSLSPGERATLSCSASSGVNFMHWYQQKPGQAPRRLIFDTSKLASGIPARFSGSGSGTDYTLTISSLEPEDFAVYYCQQWSFNPPTFGQGTKVEIKR

SEQ ID NO: 16911 - protein, 107 aa, Artificial Sequence
  Description of Artificial Sequence: Synthetic polypeptide
  Humanized mouse sequence
QIVLTQSPATLSLSPGERATLSCSASSGVNFMHWYQQKPGQAPKRLIFDTSKLASGVPARFSGSGSGTDYTLTISSLEPEDFAVYYCQQWSFNPPTFGQGTKVEIKR

SEQ ID NO: 16912 - protein, 108 aa, Artificial Sequence
  Description of Artificial Sequence: Synthetic polypeptide
  Synthetic sequence: B2 VL domain
EIVLTQSPGTLSLSPGEKATLSCRASQSVSVAFLAWYQQKPGQAPRLLIYGASSRATGIPDRFSGSGSGTDFTLTISRLEPEDFAVYYCQQMRGRPPTFGQGTKVEIK

SEQ ID NO: 16913 - protein, 108 aa, Artificial Sequence
  Description of Artificial Sequence: Synthetic polypeptide
  Synthetic sequence: B7 VL domain
EIVLTQSPGTLSLSPGEKATLSCRASQSVSLAFLAWYQQKPGQAPRLLIYGASSRATGIPDRFSGSGSGTDFTLTISRLEPEDFAVYYCQQMRGRPPTFGQGTKVEIK

SEQ ID NO: 16914 - protein, 108 aa, Artificial Sequence
  Description of Artificial Sequence: Synthetic polypeptide
  Synthetic sequence: C5 VL domain
EIVLTQSPGTLSLSPGEKATLSCRASQSVSLHFLAWYQQKPGQAPRLLIYGASSRATGIPDRFSGSGSGTDFTLTISRLEPEDFAVYYCQQMRGRPPTFGQGTKVEIK

SEQ ID NO: 16915 - protein, 108 aa, Artificial Sequence
  Description of Artificial Sequence: Synthetic polypeptide
  Synthetic sequence: C8 VL domain
EIVLTQSPGTLSLSPGEKATLSCRASQSVSLPFLAWYQQKPGQAPRLLIYGASSRATGIPDRFSGSGSGTDFTLTISRLEPEDFAVYYCQQMRGRPPTFGQGTKVEIK

SEQ ID NO: 16916 - protein, 108 aa, Artificial Sequence
  Description of Artificial Sequence: Synthetic polypeptide
  Synthetic sequence: D5 VL domain
EIVLTQSPGTLSLSPGEKATLSCRASQSVSNAFLAWYQQKPGQAPRLLIYGASSRATGIPDRFSGSGSGTDFTLTISRLEPEDFAVYYCQQMRGRPPTFGQGTKVEIK

SEQ ID NO: 16917 - protein, 108 aa, Artificial Sequence
  Description of Artificial Sequence: Synthetic polypeptide
  Synthetic sequence: E5 VL domain
EIVLTQSPGTLSLSPGEKATLSCRASQSVSLAHLAWYQQKPGQAPRLLIYGASSRATGIPDRFSGSGSGTDFTLTISRLEPEDFAVYYCQQMRGRPPTFGQGTKVEIK

SEQ ID NO: 16918 - protein, 108 aa, Artificial Sequence
  Description of Artificial Sequence: Synthetic polypeptide
  Synthetic sequence: E8 VL domain
EIVLTQSPGTLSLSPGEKATLSCRASQSVSSSFLAWYQQKPGQAPRLLIYGASSRATGIPDRFSGSGSGTDFTLTISRLEPEDFAVYYCQQMRGRPPTFGQGTKVEIK

SEQ ID NO: 16919 - protein, 108 aa, Artificial Sequence
  Description of Artificial Sequence: Synthetic polypeptide
  Synthetic sequence: F1 VL domain
EIVLTQSPGTLSLSPGEKATLSCRASQSVSAPFLAWYQQKPGQAPRLLIYGASSRATGIPDRFSGSGSGTDFTLTISRLEPEDFAVYYCQQMRGRPPTFGQGTKVEIK

SEQ ID NO: 16920 - protein, 108 aa, Artificial Sequence
  Description of Artificial Sequence: Synthetic polypeptide
  Synthetic sequence: F8 VL domain
EIVLTQSPGTLSLSPGEKATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 16921 - protein, 108 aa, Artificial Sequence
  Description of Artificial Sequence: Synthetic polypeptide
  Synthetic sequence: F8 VL K18R domain
EIVLTQSPGTLSLSPGERATLSCRASQSVSMPFLAWYQQKPGQAPRLLIYGASSRATGIPDRFSGSGSGTDFTLTISRLEPEDFAVYYCQQMRGRPPTFGQGTKVEIK

SEQ ID NO: 16922 - protein, 108 aa, Artificial Sequence
  Description of Artificial Sequence: Synthetic polypeptide
  Synthetic sequence: G9 VL domain
EIVLTQSPGTLSLSPGEKATLSCRASQSVSTAFLAWYQQKPGQAPRLLIYGASSRATGIPDRFSGSGSGTDFTLTISRLEPEDFAVYYCQQMRGRPPTFGQGTKVEIK

SEQ ID NO: 16923 - protein, 108 aa, Artificial Sequence
  Description of Artificial Sequence: Synthetic polypeptide
  Synthetic sequence: H1 VL domain
EIVLTQSPGTLSLSPGEKATLSCRASQSVSSAWLAWYQQKPGQAPRLLIYGASSRATGIPDRFSGSGSGTDFTLTISRLEPEDFAVYYCQQMRGRPPTFGQGTKVEIK

SEQ ID NO: 16924 - protein, 108 aa, Artificial Sequence
  Description of Artificial Sequence: Synthetic polypeptide
  Synthetic amino acid sequence of antibody SW01 - VL
SELTQDPAVSVALGQTVRITCQGDSLRSYYASWYQQKPGQAPVLVIYGKNNRPSGIPDRFSGSSSGNTASLTITGAQAEDEADYYCNSSPKAPRPVVFGGGTKLTVLG

SEQ ID NO: 16925 - protein, 108 aa, Artificial Sequence
  Description of Artificial Sequence: Synthetic polypeptide
  Synthetic amino acid sequence of antibody SW02 - V
SELTQDPAVSVALGQTVRITCQGDSLRSYYASWYQQKPGQAPVLVIYGKNNRPSGIPDRFSGSSSGNTASLTITGAQAEDEADYYCNSSPLYNPYVVFGGGTKLTVLG

SEQ ID NO: 16926 - protein, 107 aa, Artificial Sequence
  Description of Artificial Sequence: Synthetic polypeptide
  anti-FLT3 chimeric single variable domain light chain (clone 4G8) VL
DIVLTQSPATLSVTPGDSVSLSCRASQSISNNLHWYQQKSHESPRLLIKYASQSISGIPSRFSGSGSGTDFTLSINSVETEDFGVYFCQQSNTWPYTFGGGTKLEIK

SEQ ID NO: 16927 - protein, 113 aa, Artificial Sequence
  Description of Artificial Sequence: Synthetic polypeptide
  anti-FLT3 single variable domain VL (clone BV10)
DIVMTQSPSSLSVSAGEKVTMSCKSSQSLLNSGNQKNYMAWYQQKPGQPPKLLIYGASTRESGVPDRFTGSGSGTDFTLTISSVQAEDLAVYYCQNDHSYPLTFGAGTKLELK

SEQ ID NO: 16928 - protein, 113 aa, Artificial Sequence; identical to SEQ ID NO: 7671
  Description of Artificial Sequence: Synthetic polypeptide
  Humanized Immunoglobulin Light Chain Variable Region

SEQ ID NO: 16929 - protein, 108 aa, Artificial Sequence
  Description of Artificial Sequence: Synthetic polypeptide
  Murine KM666 VL (light chain variable region) sequence
ENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVK

SEQ ID NO: 16930 - protein, 108 aa, Artificial Sequence
  Description of Artificial Sequence: Synthetic polypeptide
  Humanised KM666 VL sequence
ENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIK

SEQ ID NO: 16931 - protein, 112 aa, Artificial Sequence
  Description of Artificial Sequence: Synthetic polypeptide
DVVMTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPFTFGPGTKVDIK

SEQ ID NO: 16932 - protein, 112 aa, Artificial Sequence
  Description of Artificial Sequence: Synthetic polypeptide
DIQVTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGIKVDIK

SEQ ID NO: 16933 - protein, 113 aa, Artificial Sequence
  Description of Artificial Sequence: Synthetic polypeptide
DIQMTQSPDSLAVSLGERATINCKSSQSVLYSPNKKNYLAWYQQKPGQPPSLLFYWASTRESGVPDRFSGSGSGTDFTLTISSLQAEDVAVYYCQQYYSTPPTFGQGTKVEIK

SEQ ID NO: 16934 - protein, 113 aa, Artificial Sequence
  Description of Artificial Sequence: Synthetic polypeptide
DVVMTQTPDSLAVSLGERATINCKSSQSVLYISNNKNYLAWYQQKPGQPPKLLIYWASTRESGVPDRFSGSGSGTDFTLTISSLQAEDVAVYYCQHYYSTPPTFGQGTKLEIK

SEQ ID NO: 16935 - protein, 113 aa, Artificial Sequence
  Description of Artificial Sequence: Synthetic polypeptide
DIRVTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 16936 - protein, 113 aa, Artificial Sequence
  Description of Artificial Sequence: Synthetic polypeptide
DIQLTQSPDSLAVSLGERATINCKSSQSILYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 16937 - protein, 112 aa, Artificial Sequence
  Description of Artificial Sequence: Synthetic polypeptide
EIVMTQSPLSLPVTPGEPASISCTSSQSLLHSNGYNYLDWYLQKPGQSPQLLIYLGSNRASGVPDRFSGSGSGTDFTLKISTVEAEDVGVYYCMQALQTPWTFGQGTKVEIK

SEQ ID NO: 16938 - protein, 112 aa, Artificial Sequence
  Description of Artificial Sequence: Synthetic polypeptide
EIVLTQSPLSLSVTPGEPASISCRSSQSLLHRNGYNYFDWYLQQPGQSPQLLIYLGSNRASGVPDRFSGSGSGTDFTLKISRVEAEDVGVYYCMQALQTPYTFGQGTKLEIK

SEQ ID NO: 16939 - protein, 107 aa, Artificial Sequence
  Description of Artificial Sequence: Synthetic polypeptide
DIRMTQSPSSLSASVGDRVTITCRASQGISNYLAWYQQKPGKVPKFLIYAASTLQSGVPSRFSGSGSGTDFTLTISSLQPEDVATYYCQKYNSAPWTFGQGTKVEIK

SEQ ID NO: 16940 - protein, 113 aa, Artificial Sequence
  Description of Artificial Sequence: Synthetic polypeptide
DIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKLEIK

SEQ ID NO: 16941 - protein, 102 aa, Homo sapiens
EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRT

SEQ ID NO: 16942 - protein, 108 aa, Artificial Sequence
  Description of Artificial Sequence: Synthetic polypeptide
DIQMTQSPSSLSASVGDRVTITCSASQDISNYLNWYQQKPDKAVKLLIFYSSNLHSGVPSRFSGGGSGTDYTLTISSLQPEDIATYFCHQYSKLPWTFGQGTKVEIKR

SEQ ID NO: 16943 - protein, 108 aa, Mus musculus
DIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKR

SEQ ID NO: 16944 - protein, 92 aa, Artificial Sequence
  Description of Artificial Sequence: Synthetic polypeptide
DRVTITCSASQDISNYLNWYQQKPDKAPKLLIFYSSNLHSGVPSRFSGGGSGTDYTLTISSLQPEDIATYFCHQYSKLPWTFGQGTKVEIKR

SEQ ID NO: 16945 - protein, 113 aa, Artificial Sequence
  Description of Artificial Sequence: Synthetic polypeptide
  Light chain variable region of mature IgM-protein PolrecCHOIgM/GD3
DIVMTQSPDSLAVSLGERATINCKSSQSVLYSSNKKNYLAWYQQKPGQPPKLLIYWASTRESGVPDRFTGSGSGTDFTLTISSLQAEDVAVYYCQQYYSTPLTFGPGTKVDIK

SEQ ID NO: 16946 - protein, 92 aa, Mus musculus
DRVTISCSASQDISNYLNWYQQKPDGTVKLLIFYSSNLHSGVPSRFSGGGSGTDYSLTISNLEPEDIATYFCHQYSKLPWTFGGGTKLEIKR

SEQ ID NO: 16947 - protein, 128 aa, Artificial Sequence
  Description of Artificial Sequence: Synthetic polypeptide
  chimeic human antibody
MMAPVQLLGLLLIWLPAMRCDIQMTQSPSFLSASVGDRVTINCKASQNINKYLNWYQQKLGEAPKRLIYNTNNLQTGIPSRFSGSGSGTDYTLTISSLQPEDFATYFCLQHNSFPNTFGAGTKLELKR

SEQ ID NO: 16948 - protein, 129 aa, Artificial Sequence
  Description of Artificial Sequence: Synthetic polypeptide
  chimeic human antibody
MHFQVQIFSFLLISASVIMSRGQIVLTQSPAIMSASPGEKVTITCSASSSVSYMHWFQQKPGTSPKLWIYSTSNLASGVPARFSGSGSGTSYSLTISRMEAEDAATYYCQQRSSYPYTFGGGTKLEIKR

SEQ ID NO: 16949 - protein, 130 aa, Artificial Sequence
  Description of Artificial Sequence: Synthetic polypeptide
  chimeic human antibody
MHFQVQIFSFLLISASVIMSRGDIQLTQSPSSLSASPGDRVTITCSASSSVSYMHWFQQKPGKAPKLWIYSTSNLASGVPSRFSGSGSGTSYSLTISRLQPEDIATYYCQQRSSYPYTFGGGTKVEIKRT

SEQ ID NO: 16950 - protein, 130 aa, Artificial Sequence
  Description of Artificial Sequence: Synthetic polypeptide
  chimeic human antibody
MHFQVQIFSFLLISASVIMSRGDIQLTQSPSSLSASPGDRVTITCSASSSVSYMHWFQQKPGKAPKLWIYSTSNLASGVPARFSGSGSGTSYSLTISRLQPEDIATYYCQQRSSYPYTFGGGTKVEIKRT

SEQ ID NO: 16951 - protein, 107 aa, Mus musculus; identical to SEQ ID NO: 13947

SEQ ID NO: 16952 - protein, 108 aa, Artificial Sequence; identical to SEQ ID NO: 13950
  Description of Artificial Sequence: Synthetic polypeptide

SEQ ID NO: 16953 - protein, 108 aa, Artificial Sequence; identical to SEQ ID NO: 13951
  Description of Artificial Sequence: Synthetic polypeptide

SEQ ID NO: 16954 - protein, 108 aa, Artificial Sequence; identical to SEQ ID NO: 13952
  Description of Artificial Sequence: Synthetic polypeptide

SEQ ID NO: 16955 - protein, 108 aa, Artificial Sequence; identical to SEQ ID NO: 13954
  Description of Artificial Sequence: Synthetic polypeptide

SEQ ID NO: 16956 - protein, 108 aa, Artificial Sequence
  Description of Artificial Sequence: Synthetic polypeptide
  Artificial antibody domain sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPNTFGQGTKVEIKR

SEQ ID NO: 16957 - protein, 107 aa, Artificial Sequence; identical to SEQ ID NO: 14017
  Description of Artificial Sequence: Synthetic polypeptide

SEQ ID NO: 16958 - protein, 107 aa, Artificial Sequence; identical to SEQ ID NO: 14029
  Description of Artificial Sequence: Synthetic polypeptide

SEQ ID NO: 16959 - protein, 107 aa, Artificial Sequence; identical to SEQ ID NO: 14033
  Description of Artificial Sequence: Synthetic polypeptide

SEQ ID NO: 16960 - protein, 107 aa, Artificial Sequence; identical to SEQ ID NO: 4444
  Description of Artificial Sequence: Synthetic polypeptide

SEQ ID NO: 16961 - protein, 106 aa, Artificial Sequence
  Description of Artificial Sequence: Synthetic polypeptide
  Synthetic Humanized 4384 VL polypeptide
  MOD_RES (44)..(44): Pro or Val
  MOD_RES (48)..(48): Ile or Met
  MOD_RES (70)..(70): Phe or Tyr
  MOD_RES (72)..(72): Phe or Leu
  MOD_RES (86)..(86): Tyr or Phe
DIQMTQSPSSLSASVGDRVTITCRSSQDISNYLNWYQQKPGKAXKLLXYISRLHSGVPSRFSGSGSGTDXTXTISSLQPEDIATYXCQQGNTLPLTFGGGTKVEIK

SEQ ID NO: 16962 - protein, 107 aa, Artificial Sequence
  Description of Artificial Sequence: Synthetic polypeptide
  Synthetic Humanized 4517 VL polypeptide
  MOD_RES (13)..(13): Ala or Val
  MOD_RES (48)..(48): Ile or Val
  MOD_RES (56)..(56): Asp or Thr
  MOD_RES (71)..(71): Phe or Tyr
  MOD_RES (84)..(84): Ala or Gly
  MOD_RES (85)..(85): Thr or Ser
  MOD_RES (104)..(104): Val or Leu
DIQMTQSPSSLSXSVGDRVTITCRASENIYSNLAWYQQKPGKAPKLLXYAATNLAXGVPSRFSGSGSGTDXTLTISSLQPEDFXXYYCQHFWGTPWTFGQGTKXEIK

SEQ ID NO: 16963 - protein, 106 aa, Artificial Sequence
  Description of Artificial Sequence: Synthetic polypeptide
DIQMTQSPSSLSASVGDRVTITCRSSQDISNYLNWYQQKPGKAVKLLMYISRLHSGVPSRFSGSGSGTDYTFTISSLQPEDIATYYCQQGNTLPLTFGGGTKVEIK

SEQ ID NO: 16964 - protein, 107 aa, Artificial Sequence
  Description of Artificial Sequence: Synthetic polypeptide
DIQMTQSPSSLSASVGDRVTITCRASENIYSNLAWYQQKPGKAPKLLIYAATNLATGVPSRFSGSGSGTDYTLTISSLQPEDFASYYCQHFWGTPWTFGQGTKLEIK

SEQ ID NO: 16965 - protein, 106 aa, Artificial Sequence
  Description of Artificial Sequence: Synthetic polypeptide
DIQMTQSPSSLSASVGDRVTITCRSSQDISNYLNWYQQKPGKAPKLLMYISRLHSGVPSRFSGSGSGTDYTFTISSLQPEDIATYYCQQGNTLPLTFGGGTKVEIK

SEQ ID NO: 16966 - protein, 107 aa, Artificial Sequence [sequence omitted]

SEQ ID NO: 16967 - protein, 107 aa, Artificial Sequence [sequence omitted]

SEQ ID NO: 16968 - protein, 108 aa, Artificial Sequence
  Description of Artificial Sequence: Synthetic polypeptide
  antibody
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 16969 - protein, 106 aa, Artificial Sequence
  Description of Artificial Sequence: Synthetic polypeptide
EIVLTQSPATLSLSPGERATLSCSASSSVTYVHWYQQKPGQAPRLLIYDTSKLASGIPARFSGSGSGTDFTLTISSLEPEDFAVYYCFQGSGYPLTFGSGTKLEMR

SEQ ID NO: 16970 - protein, 110 aa, Artificial Sequence [sequence omitted]

SEQ ID NO: 16971 - protein, 107 aa, Artificial Sequence
  Description of Artificial Sequence: Synthetic polypeptide
  Synthetic Humanized 5038 VL polypeptide
  MOD_RES (36)..(36): Tyr or Phe
  MOD_RES (44)..(44): Pro or Val
  MOD_RES (49)..(49): Tyr or Phe
  MOD_RES (71)..(71): Phe or Tyr
  MOD_RES (73)..(73): Phe or Leu
  MOD_RES (85)..(85): Thr or Ile
  MOD_RES (87)..(87): Ile or Phe
DIQMTQSPSSLSASVGDRVTITCRPSQDISNYVNWXQQKPGKAXKLLIXHTSRLHSGVPSRFSGSGSGTDXTXTISSLQPEDIAXYXCQQGITLPWTFGQGTKVEIK

SEQ ID NO: 16972 - protein, 107 aa, Artificial Sequence
  Description of Artificial Sequence: Synthetic polypeptide
  Synthetic Humanized 5082 VL polypeptide
  MOD_RES (21)..(21): Ile or Val
  MOD_RES (29)..(29): Ile or Thr
  MOD_RES (44)..(44): Pro or Val
  MOD_RES (69)..(69): Thr or Ile
  MOD_RES (71)..(71): Phe or Tyr
  MOD_RES (87)..(87): Tyr or Phe
  MOD_RES (104)..(104): Val or Leu
DIQMTQSPSSLSASVGDRVTXTCRASQDXNNYLNWYQQKPGKAXKLLIYYTSRLQSGVPSRFSGSGSGXDXTLTISSLQPEDFATYXCQQSETLPWTFGQGTKXEIK

SEQ ID NO: 16973 - protein, 107 aa, Artificial Sequence
  Description of Artificial Sequence: Synthetic polypeptide
DIQMTQSPSSLSASVGDRVTITCRPSQDISNYVNWFQQKPGKAVKLLIFHTSRLHSGVPSRFSGSGSGTDFTFTISSLQPEDIAIYYCQQGITLPWTFGQGTKVEIK

SEQ ID NO: 16974 - protein, 107 aa, Artificial Sequence
  Description of Artificial Sequence: Synthetic polypeptide
DIQMTQSPSSLSASVGDRVTITCRPSQDISNYVNWFQQKPGKAPKLLIFHTSRLHSGVPSRFSGSGSGTDFTLTISSLQPEDIATYYCQQGITLPWTFGQGTKVEIK

SEQ ID NO: 16975 - protein, 107 aa, Artificial Sequence
  Description of Artificial Sequence: Synthetic polypeptide
DIQMTQSPSSLSASVGDRVTVTCRASQDTNNYLNWYQQKPGKAVKLLIYYTSRLQSGVPSRFSGSGSGTDFTLTISSLQPEDFATYFCQQSETLPWTFGQGTKVEIK

SEQ ID NO: 16976 - protein, 107 aa, Artificial Sequence
  Description of Artificial Sequence: Synthetic polypeptide
DIQMTQSPSSLSASVGDRVTVTCRASQDINNYLNWYQQKPGKAVKLLIYYTSRLQSGVPSRFSGSGSGTDYTLTISSLQPEDFATYFCQQSETLPWTFGQGTKLEIK

SEQ ID NO: 16977 - protein, 111 aa, Artificial Sequence
  Description of Artificial Sequence: Synthetic polypeptide
DIQMTQSPSSLSASVGDRVTITCRSSQSLVHSNGNTYLHWYQQKPGKAPKLLIYKVSNRFSGVPSRFSGSGSGTDFTLTISSLQPEDFATYYCSQSTHVPTFGGGTKVEIK

SEQ ID NO: 16978 - protein, 108 aa, Artificial Sequence
  Description of Artificial Sequence: Synthetic polypeptide
DIPLTQSPSSLSASVGDRVTITCRASQGISNYLAWYQQKPGKVPKLLIYAASTLQSGVPSRFSGSGSGTDFTLTIHSLQPEDVATYYCQKYNSAPWTFGQGTKLEIKR

SEQ ID NO: 16979 - protein, 110 aa, Homo sapiens
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 16980 - protein, 110 aa, Homo sapiens
QSVLTQPPSVSGTPGQRVTISCSGSSSNIGSNTVNWYQQLPGTAPKLLIYNNDQRPSGVPDRFSGSKSGTSGSLAISGLQSEDEADYYCASWDDSLNGRVFGGGTKLTVL

SEQ ID NO: 16981 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDSLNGRVFGGGTKLTVL

SEQ ID NO: 16982 - protein, 110 aa, Homo sapiens
QSVLTQPPSVSGTPGQRVTISCSGSGSNIGSNTVNWYQQLPGTAPKLLIYNNGQRPSGVPDRFSGSKSGTSGSLAISGLQSEDEADYYCASWDDSLNGRVFGGGTKLTVL

SEQ ID NO: 16983 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDLSLNFRFGGGTKLTVL

SEQ ID NO: 16984 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDLTLDHLFGGGTKLTVL

SEQ ID NO: 16985 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDMNLDHVFGGGTKLTVL

SEQ ID NO: 16986 - protein, 110 aa, Homo sapiens
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDTLGSRVFGGGTKLTVL

SEQ ID NO: 16987 - protein, 110 aa, Homo sapiens
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDHKGTRVFGGGTKLTVL

SEQ ID NO: 16988 - protein, 110 aa, Homo sapiens
QSVLTQPPSASGTPGQRVTISCSGSSSNIGSNTVNWYQRLPGAAPQLLIYNNDQRPSGIPDRFSGSKSGTSGSLVISGLQSEDEADYYCETFDTSLNGRVFGGGTKLTVL

SEQ ID NO: 16989 - protein, 110 aa, Homo sapiens
QSVLTQPPSASGTPGQRVTISCSGSSSNIGSNTVNWYQRLPGAAPQLLIYNNDQRPSGIPDRFSGSKSGTSGSLVISGLQSEDEADYYCETGSSTLNGRVFGGGTKLTVL

SEQ ID NO: 16990 - protein, 110 aa, Homo sapiens
QSVLTQPPSASGTPGQRVTISCSGSSSNIGSNTVNWYQRLPGAAPQLLIYNNDQRPSGIPDRFSGSKSGTSGSLVISGLQSEDEADYYCATGDKNLNGRVFGGGTKLTVL

SEQ ID NO: 16991 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDHTLNFEFGGGTKLTVL

SEQ ID NO: 16992 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDRDLNFVFGGGTKLTVL

SEQ ID NO: 16993 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDLTWDHVFGGGTKLTVL

SEQ ID NO: 16994 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDRLLSFEFGGGTKLTVL

SEQ ID NO: 16995 - protein, 110 aa, Homo sapiens
QSVLTQPPSASGTPGQRVTISCSGSGSNIGSNTVNWYQRLPGAAPQLLIYNNGQRPSGIPDRFSGSKSGTSGSLVISGLQSEDEADYYCASWDDRLLNFVFGGGTKLTVL

SEQ ID NO: 16996 - protein, 110 aa, Homo sapiens
QSVLTQPPSASGTPGQRVTIPCSGSSSNIGSSTVNWYQRLPGAAPQLLIYNNDQRPSGIPDRFSGSKSGTSGSLVISGLQSEDEADYYCATWDDSLNGRVFGGGTKLTVL

SEQ ID NO: 16997 - protein, 110 aa, Homo sapiens
QSVLTQPPSASGTPGQRVTISCSGSSSNIGSNTVNWYQRLPGAAPQLLVYNNDQRPSGIPDRFSGSKSGTSGSLVIGGLQSEDEADYYCESWDDSLNGRVFGGGTKLTVL

SEQ ID NO: 16998 - protein, 110 aa, Homo sapiens
QSVLTQPPSASGTPGQRVTISCSGSSSNIGSNTVNWYQRLPGAAPQLLVYNNDQRPSGIPDRFSGSKSGTSGSLVIGGLQSEDEADYYCESWDDSLSGRVFGGGTKLTVL

SEQ ID NO: 16999 - protein, 110 aa, Homo sapiens
QSVLAQPPSASGTPGQRVTISCSGSSSNIGGSTVNWYQQLPGAAPRLLIYNNDQRPSGVPDRFSGSKSGTSGSLVISGLQSEDEADYYCASWDDSLSGRVFGGGTKLTVL

SEQ ID NO: 17000 - protein, 110 aa, Homo sapiens
QSVLTQPPSASGTPGQRVTVTCSGSSSNIGSSTVNWYQRLPGAAPQLLIYNNDRRPSGIPDRFSGSKSGTSGSLVISGLQSEDEADYYCATWDDRLNGRVFGGGTKLTVL

SEQ ID NO: 17001 - protein, 110 aa, Homo sapiens
QSVLSQPPSASGTPGRRVTISCSGSSSNIGSSTVNWYRRLPGAAPQLLIYNNDQRPSGIPDRFSGSRSGTSGSLVISGLQSEDEADYYCASWDDNLNGRVFGGGTKLTVL

SEQ ID NO: 17002 - protein, 110 aa, Homo sapiens
QSVLAQPPSASGTPGQRVTISCSGSSSNIGGSTVNWYQQLPGAAPRLLIYNNDQRPSGVPDRFSGSKSGTSGSLVISGLQSEDEADYYCESWDDSLNGRVFGGGTKLTVL

SEQ ID NO: 17003 - protein, 110 aa, Homo sapiens
QSVLTQPPSASGTPGQRVTISCSGSSSNIGSSTVNWYRRLPGAAPQLLIYNNDQRPSGIPDRFSGSRSGTSGSLVISGLQSEDEADYYCESWDDSLNGRVFGGGTKLTVL

SEQ ID NO: 17004 - protein, 110 aa, Homo sapiens
QSVLTQPPSVSGTPGQRVTISCSGSSSNIGSSTVNWYQQLPGTAPKLLIYNNDQRPSGVPDRFSGSRSGTSGSLAISGLQSEDEADYYCESWDDSLSGRVFGGGTKLTVL

SEQ ID NO: 17005 - protein, 110 aa, Homo sapiens
RSVLTQPPSASGTPGQRVTTSCSGSSSNIGSNTVNWYQQLPGAAPRLLIYNNDQRPSGIPDRFSGSKSGTSGSLVIGGLQSEDEADYYCESWDDSLNGRVFGGGTKLTVL

SEQ ID NO: 17006 - protein, 110 aa, Homo sapiens
QSVLAQPPSASGTPGQRVTISCSGSSSNIGGSTVNWYQQLPGAAPRLLIYNNDQRPSGVPDRFSGSKSGTSGSLVIGGLQSEDEADYYCESWDDSLNGRVFGGGTKLTVL

SEQ ID NO: 17007 - protein, 110 aa, Homo sapiens
QSVLAQPPSASGTPGQRVTISCSGSSSNIGGSTVNWYQQLPGAAPRLLIYNNDQRPSGVPDRFSGSKSGTSGSLVISGLQSEDKADYYCESWDDSLNGRVFGGGTKLTVL

SEQ ID NO: 17008 - protein, 110 aa, Homo sapiens
QSVLTQPPSVSGTPGQRVTISCSGSSSNIGGSTVNWYQQLPGTAPKLLIYNNDQRPSGVPDRFSGSKSGTSGSLAISGLQSEDEADYYCESWDDSLSGRVFGGGTKLTVL

SEQ ID NO: 17009 - protein, 110 aa, Homo sapiens
QSVLTQPPSASGTPGQRVIIPCSGSSSNIGSSTVNWYRRLPGAAPQLLIYNNDRRPSGIPDRFSGSKSGTSGSLVIGGLQSEDEADYYCESWDDGLNGRVFGGGTKLTVL

SEQ ID NO: 17010 - protein, 110 aa, Homo sapiens
QSVLTQPPSVSGTPGQRVTISCSGSSSNIGSSTVNWYQQLPGTAPKLLIYNNDRRPSGVPDRFSGSKSGTSGSLAISGLQSEDEADYYCESWDDGLSGRVFGGGTKLTVL

SEQ ID NO: 17011 - protein, 110 aa, Homo sapiens
  MOD_RES (1)..(1): Gln or Arg
  MOD_RES (5)..(5): Thr, Ala or Ser
  MOD_RES (10)..(10): Ala or Val
  MOD_RES (16)..(16): Gln or Arg
  MOD_RES (19)..(19): Thr or Ile
  MOD_RES (20)..(20): Thr, Ile or Val
  MOD_RES (21)..(21): Pro, Ser or Thr
  MOD_RES (31)..(31): Ser or Gly
  MOD_RES (32)..(32): Ser or Asn
  MOD_RES (38)..(38): Gln or Arg
  MOD_RES (39)..(39): Arg or Gln
  MOD_RES (43)..(43): Ala or Thr
  MOD_RES (46)..(46): Gln, Arg or Lys
  MOD_RES (49)..(49): Ile or Val
  MOD_RES (54)..(54): Gln or Arg
  MOD_RES (59)..(59): Ile or Val
  MOD_RES (67)..(67): Lys or Arg
  MOD_RES (75)..(75): Val or Ala
  MOD_RES (77)..(77): Ser or Gly
  MOD_RES (84)..(84): Glu or Lys
  MOD_RES (90)..(90): Ala or Glu
  MOD_RES (91)..(91): Thr or Ser
  MOD_RES (92)..(92): Trp or Phe
  MOD_RES (94)..(94): Asp or Thr
  MOD_RES (95)..(95): Ser, Arg, Asn or Gly
  MOD_RES (97)..(97): Asn or Ser
XSVLXQPPSXSGTPGXRVXXXCSGSSSNIGXXTVNWYXXLPGXAPXLLXYNNDXRPSGXPDRFSGSXSGTSGSLXIXGLQSEDXADYYCXXXDXXLXGRVFGGGTKLTVL

SEQ ID NO: 17012 - protein, 110 aa, Homo sapiens
  MOD_RES (10)..(10): Ala or Val
  MOD_RES (39)..(39): Gln or Arg
  MOD_RES (43)..(43): Ala or Thr
  MOD_RES (46)..(46): Gln or Lys
  MOD_RES (59)..(59): Ile or Val
  MOD_RES (75)..(75): Val or Ala
  MOD_RES (95)..(95): Ser, Leu, Met, His or Arg
  MOD_RES (96)..(96): Leu, Ser, Asn, Thr or Asp
  MOD_RES (97)..(97): Asn, Leu or Trp
  MOD_RES (98)..(98): Gly, Asn, Asp or Ser
  MOD_RES (99)..(99): Arg, Phe or His
  MOD_RES (100)..(100): Val, Arg, Leu or Glu
QSVLTQPPSXSGTPGQRVTISCSGSGSNIGSNTVNWYQXLPGXAPXLLIYNNGQRPSGXPDRFSGSKSGTSGSLXISGLQSEDEADYYCASWDDXXXXXXFGGGTKLTVL

SEQ ID NO: 17013 - protein, 107 aa, Artificial Sequence
  Description of Artificial Sequence: Synthetic polypeptide
DIQMTQSPSSLSASTGDRVTITCRASQGISSYLAWYQQKPGKAPKLLIYARSTRQSGVPSRFSGSGSGTDFTLTISSLQPEDFATYYCQQYWRWPLTFGGGTKVEIK

SEQ ID NO: 17014 - protein, 107 aa, Artificial Sequence
  Description of Artificial Sequence: Synthetic polypeptide
DIQMTQSPSSLSASTGDRVTITCRASQGISSYLAWYQQKPGKAPKLLIYAKSTLQSGVPSRFSGSGSGTDFTLTISSLQPEDFATYYCQQYWTFPLTFGGGTKVEIK

SEQ ID NO: 17015 - protein, 107 aa, Artificial Sequence
  Description of Artificial Sequence: Synthetic polypeptide
  Synthetic consensus sequence
  MOD_RES (4)..(4): Leu or Met
  MOD_RES (15)..(15): Leu or Thr
  MOD_RES (51)..(51): Arg, Ser, Lys, Ala, Gly, Gln, Thr, Asn, Pro or Asp
  MOD_RES (54)..(54): Arg, Leu, Cys, Thr, Pro, Gly, Ser, Lys, Glu, Gln, His, Ala, Tyr or Ile
  MOD_RES (70)..(70): Glu or Asp
  MOD_RES (83)..(83): Ser or Phe
  MOD_RES (84)..(84): Ala or Gly
  MOD_RES (92)..(92): Trp or Phe
  MOD_RES (93)..(93): Thr, Ala, Arg, Met, Phe, Ser, Asn, Trp, Gln, Leu or Val
  MOD_RES (94)..(94): Trp or Phe
DIQXTQSPSSLSASXGDRVTITCRASQGISSYLAWYQQKPGKAPKLLIYAXSTXQSGVPSRFSGSGSGTXFTLTISSLQPEDXXTYYCQQYXXXPLTFGGGTKVEIK

SEQ ID NO: 17016 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIK

SEQ ID NO: 17017 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIK

SEQ ID NO: 17018 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIK

SEQ ID NO: 17019 - protein, 107 aa, Artificial Sequence
  Description of Artificial Sequence: Synthetic polypeptide
DIQMTQSPSSLSASTGDRVTITCRASQGISSYLAWYQQKPGKAPKLLIYAASTLQSGVPSRFSGSGSGTDFTLTISSLQPEDFATYYCQQYFTFPLTFGGGTKVEIK

SEQ ID NO: 17020 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTCQSGVPSRFSGSGSGTDFTLTISSLQPEDSGTYYCQQYWTWPLTFGGGTKVEIK

SEQ ID NO: 17021 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAKSTRQSGVPSRFSGSGSGTDFTLTISSLQPEDSGTYYCQQYWRWPLTFGGGTKVEIK

SEQ ID NO: 17022 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTRQSGVPSRFSGSGSGTEFTLTISSLQPEDSATYYCQQYWMWPLTFGGGTKVEIK

SEQ ID NO: 17023 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTTQSGVPSRFSGSGSGTEFTLTISSLQPEDSATYYCQQYWTFPLTFGGGTKVEIK

SEQ ID NO: 17024 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAKSTRQSGVPSRFSGSGSGTDFTLTISSLQPEDSGTYYCQQYWMFPLTFGGGTKVEIK

SEQ ID NO: 17025 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTGQSGVPSRFSGSGSGTDFTLTISSLQPEDSATYYCQQYWRFPLTFGGGTKVEIK

SEQ ID NO: 17026 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTPQSGVPSRFSGSGSGTEFTLTISSLQPEDSGTYYCQQYWSFPLTFGGGTKVEIK

SEQ ID NO: 17027 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTPQSGVPSRFSGSGSGTDFTLTISSLQPEDSGTYYCQQYWTWPLTFGGGTKVEIK

SEQ ID NO: 17028 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTLQSGVPSRFSGSGSGTEFTLTISSLQPEDSATYYCQQYWMFPLTFGGGTKVEIK

SEQ ID NO: 17029 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTPQSGVPSRFSGSGSGTEFTLTISSLQPEDSATYYCQQYWNFPLTFGGGTKVEIK

SEQ ID NO: 17030 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTTQSGVPSRFSGSGSGTDFTLTISSLQPEDSGTYYCQQYWTFPLTFGGGTKVEIK

SEQ ID NO: 17031 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTSQSGVPSRFSGSGSGTDFTLTISSLQPEDSGTYYCQQYWWWPLTFGGGTKVEIK

SEQ ID NO: 17032 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTPQSGVPSRFSGSGSGTEFTLTISSLQPEDSATYYCQQYWWWPLTFGGGTKVEIK

SEQ ID NO: 17033 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTLQSGVPSRFSGSGSGTEFTLTISSLQPEDSATYYCQQYWMFPLTFGGGTKVEIK

SEQ ID NO: 17034 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAQSTKQSGVPSRFSGSGSGTEFTLTISSLQPEDSGTYYCQQYWTWPLTFGGGTKVEIK

SEQ ID NO: 17035 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTEQSGVPSRFSGSGSGTEFTLTISSLQPEDSGTYYCQQYWSFPLTFGGGTKVEIK

SEQ ID NO: 17036 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWRWPLTFGGGTKVEIK

SEQ ID NO: 17037 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTQQSGVPSRFSGSGSGTEFTLTISSLQPEDSGTYYCQQYWSWPLTFGGGTKVEIK

SEQ ID NO: 17038 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTPQSGVPSRFSGSGSGTDFTLTISSLQPEDSATYYCQQYWRFPLTFGGGTKVEIK

SEQ ID NO: 17039 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTLQSGVPSRFSGSGSGTEFTLTISSLQPEDSATYYCQQYWTFPLTFGGGTKVEIK

SEQ ID NO: 17040 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTSQSGVPSRFSGSGSGTEFTLTISSLQPEDSGTYYCQQYWTWPLTFGGGTKVEIK

SEQ ID NO: 17041 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTLQSGVPSRFSGSGSGTDFTLTISSLQPEDSATYYCQQYWSWPLTFGGGTKVEIK

SEQ ID NO: 17042 - protein, 107 aa, Artificial Sequence
  Description of Artificial Sequence: Synthetic polypeptide
DIQLTQSPSSLSASLGDRVTITCRASQGISSYLAWYQQKPGKAPKLLIYATSTLQSGVPSRFSGSGSGTEFTLTISSLQPEDSGTYYCQQYWRFPLTFGGGTKVEIK

SEQ ID NO: 17043 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTRQSGVPSRFSGSGSGTEFTLTISSLQPEDSATYYCQQYWTFPLTFGGGTKVEIK

SEQ ID NO: 17044 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTHQSGVPSRFSGSGSGTDFTLTISSLQPEDSATYYCQQYWRWPLTFGGGTKVEIK

SEQ ID NO: 17045 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTRQSGVPSRFSGSGSGTDFTLTISSLQPEDSATYYCQQYWTFPLTFGGGTKVEIK

SEQ ID NO: 17046 - protein, 107 aa, Artificial Sequence
  Description of Artificial Sequence: Synthetic polypeptide
DIQMTQSPSSLSASLGDRVTITCRASQGISSYLAWYQQKPGKAPKLLIYANSTAQSGVPSRFSGSGSGTEFTLTISSLQPEDSATYYCQQYWRWPLTFGGGTKVEIK

SEQ ID NO: 17047 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTTQSGVPSRFSGSGSGTDFTLTISSLQPEDSATYYCQQYWTFPLTFGGGTKVEIK

SEQ ID NO: 17048 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAQSTLQSGVPSRFSGSGSGTDFTLTISSLQPEDSGTYYCQQYWRFPLTFGGGTKVEIK

SEQ ID NO: 17049 - protein, 107 aa, Artificial Sequence
  Description of Artificial Sequence: Synthetic polypeptide
DIQMTQSPSSLSASLGDRVTITCRASQGISSYLAWYQQKPGKAPKLLIYATSTAQSGVPSRFSGSGSGTDFTLTISSLQPEDSGTYYCQQYWMFPLTFGGGTKVEIK

SEQ ID NO: 17050 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTTQSGVPSRFSGSGSGTEFTLTISSLQPEDSGTYYCQQYWSFPLTFGGGTKVEIK

SEQ ID NO: 17051 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAPSTPQSGVPSRFSGSGSGTEFTLTISSLQPEDSATYYCQQYWMFPLTFGGGTKVEIK

SEQ ID NO: 17052 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTLQSGVPSRFSGSGSGTEFTLTISSLQPEDSGTYYCQQYWTWPLTFGGGTKVEIK

SEQ ID NO: 17053 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTRQSGVPSRFSGSGSGTDFTLTISSLQPEDSGTYYCQQYWSFPLTFGGGTKVEIK

SEQ ID NO: 17054 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTPQSGVPSRFSGSGSGTEFTLTISSLQPEDSATYYCQQYWRFPLTFGGGTKVEIK

SEQ ID NO: 17055 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTTQSGVPSRFSGSGSGTDFTLTISSLQPEDSGTYYCQQYWRWPLTFGGGTKVEIK

SEQ ID NO: 17056 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTSQSGVPSRFSGSGSGTDFTLTISSLQPEDSATYYCQQYWQFPLTFGGGTKVEIK

SEQ ID NO: 17057 - protein, 107 aa, Artificial Sequence
  Description of Artificial Sequence: Synthetic polypeptide
DIQMTQSPSSLSASLGDRVTITCRASQGISSYLAWYQQKPGKAPKLLIYATSTAQSGVPSRFSGSGSGTDFTLTISSLQPEDSATYYCQQYWFWPLTFGGGTKVEIK

SEQ ID NO: 17058 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTRQSGVPSRFSGSGSGTEFTLTISSLQPEDSATYYCQQYWLFPLTFGGGTKVEIK

SEQ ID NO: 17059 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTRQSGVPSRFSGSGSGTEFTLTISSLQPEDSGTYYCQQYWWFPLTFGGGTKVEIK

SEQ ID NO: 17060 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTYQSGVPSRFSGSGSGTEFTLTISSLQPEDSGTYYCQQYWRWPLTFGGGTKVEIK

SEQ ID NO: 17061 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTIQSGVPSRFSGSGSGTEFTLTISSLQPEDSATYYCQQYWTFPLTFGGGTKVEIK

SEQ ID NO: 17062 - protein, 107 aa, Artificial Sequence
  Description of Artificial Sequence: Synthetic polypeptide
DIQMTQSPSSLSASLGDRVTITCRASQGISSYLAWYQQKPGKAPKLLIYARSTPQSGVPSRFSGSGSGTEFTLTISSLQPEDSATYYCQQYWLFPLTFGGGTKVEIK

SEQ ID NO: 17063 - protein, 107 aa, Artificial Sequence
  Description of Artificial Sequence: Synthetic polypeptide
DIQMTQSPSSLSASLGDRVTITCRASQGISSYLAWYQQKPGKAPKLLIYAASTLQSGVPSRFSGSGSGTDFTLTISSLQPEDSGTYYCQQYWFFPLTFGGGTKVEIK

SEQ ID NO: 17064 - protein, 107 aa, Artificial Sequence
  Description of Artificial Sequence: Synthetic polypeptide
DIQMTQSPSSLSASLGDRVTITCRASQGISSYLAWYQQKPGKAPKLLIYASSTHQSGVPSRFSGSGSGTEFTLTISSLQPEDSGTYYCQQYWTFPLTFGGGTKVEIK

SEQ ID NO: 17065 - protein, 107 aa, Artificial Sequence
  Description of Artificial Sequence: Synthetic polypeptide
DIQLTQSPSSLSASLGDRVTITCRASQGISSYLAWYQQKPGKAPKLLIYASSTRQSGVPSRFSGSGSGTEFTLTISSLQPEDSATYYCQQYWVWPLTFGGGTKVEIK

SEQ ID NO: 17066 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTRQSGVPSRFSGSGSGTDFTLTISSLQPEDSATYYCQQYWTWPLTFGGGTKVEIK

SEQ ID NO: 17067 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAASTRQSGVPSRFSGSGSGTEFTLTISSLQPEDSGTYYCQQYWTWPLTFGGGTKVEIK

SEQ ID NO: 17068 - protein, 107 aa, Artificial Sequence
  Description of Artificial Sequence: Synthetic polypeptide
DIQLTQSPSSLSASLGDRVTITCRASQGISSYLAWYQQKPGKAPKLLIYARSTLQSGVPSRFSGSGSGTEFTLTISSLQPEDSGTYYCQQYWTFPLTFGGGTKVEIK

SEQ ID NO: 17069 - protein, 107 aa, Artificial Sequence
  Description of Artificial Sequence: Synthetic polypeptide
DIQMTQSPSSLSASLGDRVTITCRASQGISSYLAWYQQKPGKAPKLLIYADSTSQSGVPSRFSGSGSGTEFTLTISSLQPEDSATYYCQQYWTFPLTFGGGTKVEIK

SEQ ID NO: 17070 - protein, 107 aa, Artificial Sequence
  Description of Artificial Sequence: Synthetic polypeptide
DIQLTQSPSSLSASLGDRVTITCRASQGISSYLAWYQQKPGKAPKLLIYAGSTPQSGVPSRFSGSGSGTEFTLTISSLQPEDSGTYYCQQYWTWPLTFGGGTKVEIK

SEQ ID NO: 17071 - protein, 108 aa, Mus musculus
DIVMTQSHKFMSTSVGDRVSITCKASQEVGTAVAWYQQKPGQSPKLLIYWASTRHTGVPDRFTGSGSGTDFTLTISNVQSEDLADYFCQQYSNYPLTFGAGAKLELKR

SEQ ID NO: 17072 - protein, 108 aa, Artificial Sequence; identical to SEQ ID NO: 12960
  Description of Artificial Sequence: Synthetic polypeptide

SEQ ID NO: 17073 - protein, 107 aa, Artificial Sequence; identical to SEQ ID NO: 9078
  Description of Artificial Sequence: Synthetic polypeptide

SEQ ID NO: 17074 - protein, 125 aa, Mus musculus
  Mouse monoclonal antibody B1 Fv Light chain region
DVVMTQTPLSLPVSLGDQASISCRSSQNLVHSDGKTYLHWFLQKPGQSPTLLIYKVSNRFSGVPDRFSGSGSGTDFILKISRVEAEDLGVYFCSQSTHVPLTFGAGTKLELKRADAAPTVSIFPP

SEQ ID NO: 17075 - protein, 112 aa, Mus musculus
  Mouse monoclonal antibody B3 Variable Light chain (V-L)
DVLMTQSPLSLPVSLGDQASISCRSSQIIVHSNGNTYLEWYLQKPGQSPKLLIYKVSNRFSGVPDRFSGSGSGTDFTLKISRVEAEDLGVYYCFQGSHVPFTFGSGTKLEIK

SEQ ID NO: 17076 - protein, 112 aa, Artificial Sequence
  Description of Artificial Sequence: Synthetic polypeptide
  Humanized B3 Variable Light chain (VL) (HumB3V-L)
DVLMTQSPLSLPVTPGEPASISCRSSQIIVHSNGNTYLEWYLQKPGQSPQLLIYKVSNRFSGVPDRFSGSGSGTDFTLKISRVEAEDVGVYYCFQGSHVPFTFGQGTKVEIK

SEQ ID NO: 17077 - protein, 125 aa, Mus musculus
  Mouse monoclonal antibody B5 Fv Light chain region
DVLLTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPFTFGSGTKLEIKRADAAPTVSIFPP

SEQ ID NO: 17078 - protein, 112 aa, Artificial Sequence
  Description of Artificial Sequence: Synthetic polypeptide
DIQMTQSPSSLSASVGDRVTITCRSSQRIVHSNGNTYLEWYQQTPGKAPKLLIYKVSNRFSGVPSRFSGSGSGTDYTFTISSLQPEDIATYYCFQGSHVPFTFGQGTKLQIT

SEQ ID NO: 17079 - protein, 107 aa, Mus musculus
DIELTQSPKFMSTSVGDRVSVTCKASQNVDTNVAWYQQKPGQSPEPLLFSASYRYTGVPDRFTGSGSGTDFTLTISNVQSEDLAEYFCQQYNSYPLTFGGGTKLEIK

SEQ ID NO: 17080 - protein, 109 aa, Artificial Sequence
  Description of Artificial Sequence: Synthetic polypeptide
  KV1; VL
DIQLTQSPSFLSASVGDRVTITCRASQNVDTNLAWYQQKPGKAPKLLIYSASYRYTGVPSRFSGSGSGTEFTLTISSLQPEDFATYYCQQYNSYPLTFGGGTKVEIKRT

SEQ ID NO: 17081 - protein, 109 aa, Artificial Sequence
  Description of Artificial Sequence: Synthetic polypeptide
  KV7; VL
DIQLTQSPSFLSASVGDRVTITCKASQNVDTNVAWYQQKPGKAPKPLIYSASYRYTGVPSRFSGSGSGTEFTLTISSLQPEDFATYYCQQYNSYPLTFGGGTKVEIKRT

SEQ ID NO: 17082 - protein, 109 aa, Artificial Sequence
  Description of Artificial Sequence: Synthetic polypeptide
  MHLG KV9; VL
DIQLTQSPSFLSASVGDRVTITCKASQNVDTNVAWYQQKPGQAPRPLIYSASYRYTGVPSRFSGSGSGTEFTLTISSLQPEDFATYYCQQYNSYPLTFGGGTKVEIKRT

SEQ ID NO: 17083 - protein, 107 aa, Artificial Sequence
  Description of Artificial Sequence: Synthetic polypeptide
  Anti-MCSP  VL
DIQMTQSPSSLSASVGDRVTITCRASQGIRNYLNWYQQKPGKAPKLLIYYTSSLHSGVPSRFSGSGSGTDFTLTISSLQPEDFATYYCQQYSKLPWTFGQGTKVEIK

SEQ ID NO: 17084 - protein, 107 aa, Artificial Sequence
  Description of Artificial Sequence: Synthetic polypeptide
  Synthetic VL MCSP clone  ML2 (G3) polypeptide
DIQMTQSPSSLSASVGDRVTITCRASQGIRNYLNWYQQKPGKAPKLLIYYTSSLHSGVPSRFSGSGSGTDYTLTISSLQPEDFATYYCQQYSALPWTFGQGTKVEIK

SEQ ID NO: 17085 - protein, 107 aa, Artificial Sequence
  Description of Artificial Sequence: Synthetic polypeptide
  Synthetic VL MCSP clone ML2 (E10) polypeptide
DIQMTQSPSSLSASVGDRVTITCRASYGIRGYLNWYQQKPGKAPKLLIYYTSSLHSGVPSRFSGSGSGTDFTLTISSLQPEDFATYHCQQYSKLPWTFGQGTKVEIK

SEQ ID NO: 17086 - protein, 107 aa, Artificial Sequence
  Description of Artificial Sequence: Synthetic polypeptide
  Synthetic VL MCSP clone ML2 (E10-G3) polypeptide
DIQMTQSPSSLSASVGDRVTITCRASYGIRGYLNWYQQKPGKAPKLLIYYTSSLHSGVPSRFSGSGSGTDFTLTISSLQPEDFATYHCQQYSALPWTFGQGTKVEIK

SEQ ID NO: 17087 - protein, 107 aa, Artificial Sequence
  Description of Artificial Sequence: Synthetic polypeptide
  VL MCSP clone ML2 (C5) polypeptide
DIQMTQSPSSLSASVGDRVTITCRASRGIREYLNWYQQKPGKAPKLLIYYTGSLHSGVPSRFSGSGSGTDFTLTISSLQPEDFATYYCQQYSELPWTFGQGTKVEIK

SEQ ID NO: 17088 - protein, 107 aa, Artificial Sequence
  Description of Artificial Sequence: Synthetic polypeptide
  VL MCSP clone ML2 (C5-G3) polypeptide
DIQMTQSPSSLSASVGDRVTITCRASRGIREYLNWYQQKPGKAPKLLIYYTGSLHSGVPSRFSGSGSGTDFTLTISSLQPEDFATYYCQQYSALPWTFGQGTKVEIK

SEQ ID NO: 17089 - protein, 108 aa, Artificial Sequence
  Description of Artificial Sequence: Synthetic polypeptide
  73R009 Light chain variable region amino acid sequence
DIVLTQSPATLSASPGEKVTLTCSASSSVSSSYLYWYQQKPGQAPKLLIYSTSNLASGVPARFSGSGSGTSYSLTISSLEPEDFATYYCHQWSSYPYTFGGGTKLEIK

SEQ ID NO: 17090 - protein, 108 aa, Artificial Sequence
  Description of Artificial Sequence: Synthetic polypeptide
  Synthetic amino acid sequence of antibody CH01 - VL
EIVLTQSPGTLSLSPGERATLSCRASQSVSSHHLAWYQQKPGQAPRLLIYDASSRATGIPDRFSGSGSGTDFTLTISRLEPEDFAVYYCQQPRGAPTTFGQGTKVEIK

SEQ ID NO: 17091 - protein, 108 aa, Homo sapiens
  Bbbt0241  VL
ETTLTQSPDTLSLSPGERATLSCRASQSLSNNFLAWYQQKSGQAPRLLIYAASSRATGIPDRFSGSGSGTDFTLTISRLEPEDFAVYYCQQYAASAITFGQGTRLEIK

SEQ ID NO: 17092 - protein, 107 aa, Homo sapiens
  Bbbt0579
DIQMTQSPSFLSASVGDRVTITCRASQGINNYLAWYQQKPGRAPKLLIYAASSLQSGVPSRFSGSGSGTDFTLTISSLQPEDFATYYCLQDSDYPLTFGGGTKLEIK

SEQ ID NO: 17093 - protein, 108 aa, Homo sapiens
  Bbbt0626  VL; Bbbt0727  VL; Bbbt0643  VL
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 17094 - protein, 108 aa, Homo sapiens
  Bbbt0632  VL
SSELTQDPAVSVALRQTVRITCQGDSLTRYYTNWYQQKPGQAPILVIYGENNRPSGIPDRFSGSRSGNTASLTITGAQAEDEADYYCNSRDNTGKHWVFGGGTKLTVL

SEQ ID NO: 17095 - protein, 110 aa, Homo sapiens
  Bbbt0654  VL
QSALTQPASVSGSPGQSITISCTATSSNVGAYNFVSWYQQHPGKAPKVLIYRVSNRPSGVSNRFSGSKSGNTASLTISGLQADDEADYYCSSYTTDYIWVFGGGTKLTVL

SEQ ID NO: 17096 - protein, 110 aa, Homo sapiens
  Bbbt0671
QSALTQPASVSGSPGQSITISCTATSSNVGAYNFVSWYQQHPGKAPKVLIYRVSNRPSGVSNRFSGSKSGNTASLTISGLQADEEADYYCSSYTTDYIWVFGGGTKLTVL

SEQ ID NO: 17097 - protein, 110 aa, Homo sapiens
  Bbbt0674  VL
QSVLTQPPSVSGTPGQRVTISCYGSSSDIGNNFVYWYQQVPGMAPKLLIYRSHQRPSGVSDRFSGSKSGTSASLAISGLRSEDEADYYCATWGDNLRGWVFGGGTKLTVL

SEQ ID NO: 17098 - protein, 108 aa, Homo sapiens
  Bbbt0726  VL
SSELTQDPAVSVALGQTVRITCQGDSLRSYYASWYQQKPGQAPVLVIYGKNNRPSGVPDRFSGSSSGNTASLTITGAQAEDEADYYCNSRDSSGNHVVFGGGTKLTVL

SEQ ID NO: 17099 - protein, 108 aa, Homo sapiens
  Bbbt0732  VL
SSELTQDPAVSVALGQTVRITCQGDSLRTYYASWYQHKPGQAPVLVMYGKDNRPSGIPDRFSGSSSGTTASLTITGAQAEDEADYYCNSRDSSGHPVVFGGGTKLTVL

SEQ ID NO: 17100 - protein, 111 aa, Homo sapiens
  Bbbt0754  VL
QAVLTQPSSVSGAPGQRVTIPCTGSSSNIGAGYDVNWYQQLPGTAPKLLIFHNNIRPSGVPDRFSGSKSGTSVSLAITGLQAEDEADYYCQSYDSSLSAWVFGGGTKVTVL

SEQ ID NO: 17101 - protein, 110 aa, Homo sapiens
  Bbbt0755  VL
QAVLTQPSSISGAPGQRVTISCTGTSSNIGAGNAVHWYQQLPGTAPRLLIFADNRRPSGVPDRFSASKSATSASLAITGLQVDDEAEYYCQSYDTRLRVVFGGGTKVTVL

SEQ ID NO: 17102 - protein, 112 aa, Artificial Sequence
  Description of Artificial Sequence: Synthetic polypeptide
  VL Sequence
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPYTFGGGTKLEIK

SEQ ID NO: 17103 - protein, 112 aa, Artificial Sequence
  Description of Artificial Sequence: Synthetic polypeptide
  LCVR
DVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 17104 - protein, 109 aa, Artificial Sequence; identical to SEQ ID NO: 14189
  Description of Artificial Sequence: Synthetic polypeptide

SEQ ID NO: 17105 - protein, 109 aa, Artificial Sequence; identical to SEQ ID NO: 14191
  Description of Artificial Sequence: Synthetic polypeptide

SEQ ID NO: 17106 - protein, 108 aa, Mus sp.; identical to SEQ ID NO: 14188

SEQ ID NO: 17107 - protein, 108 aa, Artificial Sequence
  Description of Artificial Sequence: Synthetic polypeptide
  Synthetic amino acid sequence of antibody 1E1- VL
SELTQDPAVSVALGQTVRITCQGDSLRTFYASWYQQKPGQAPVLVIYGKNNRPSGIPDRFSGSSSGNTASLTITGAQAEDEADYYCNSSLYPRTPVVFGGGTKLTVLG

SEQ ID NO: 17108 - protein, 108 aa, Artificial Sequence
  Description of Artificial Sequence: Synthetic polypeptide
  Synthetic amino acid sequence of antibody LG1 - VL
SELTQDPAVSVALGQTVRITCQGDSLRSYYASWYQQKPGQAPVLVIYGKNNRPSGIPDRFSGSSSGNTASLTITGAQAEDEADYYCNSPYRPKKLVVFGGGTKLTVLG

SEQ ID NO: 17109 - protein, 108 aa, Artificial Sequence
  Description of Artificial Sequence: Synthetic polypeptide
  Synthetic amino acid sequence of antibody LG2 - VL
SELTQDPAVSVALGQTVRITCQGDSLRSYYASWYQQKPGQAPVLVIYGKNNRPSGIPDRFSGSSSGNTASLTITGAQAEDEADYYCNSFGRALPSVVFGGGTKLTVLG

SEQ ID NO: 17110 - protein, 108 aa, Artificial Sequence
  Description of Artificial Sequence: Synthetic polypeptide
  Synthetic amino acid sequence of antibody LG3 - VL
EIVLTQSPGTLSLSPGERATLSCRASQSVSSSYLAWYQQKPGQAPRLLIYGASSRATGIPDRFSGSGSGTDFTLTISRLEPEDFAVYYCQQGGSLPLTFGQGTKVEIK

SEQ ID NO: 17111 - protein, 107 aa, Artificial Sequence; identical to SEQ ID NO: 4526
  Description of Artificial Sequence: Synthetic polypeptide
  anti-PSMA single variable domain light chain (clone J591) VL

SEQ ID NO: 17112 - protein, 108 aa, Mus musculus
DIQMTQTTSSLSASLGDRVTISCSASQGISNYLNWYQQKPDGTVKLLIYSTSSLHSGVPSRFSGSGSGTDYSLTISSLEPEDIATYYCQQYSKLPLTFGAGTKLELKR

SEQ ID NO: 17113 - protein, 108 aa, Mus musculus
DIQMTQTTSSLSASLGDRVTISCSASQGVSNYLNWYQQKPDGTVKLLIYSTSSLHSGVPSRFSGSGSGTDYSLTISNLEPEDVATYYCQQYSKLPFTFGSGTKLEIKR

SEQ ID NO: 17114 - protein, 107 aa, Mus musculus
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPLTFGAGTKLELK

SEQ ID NO: 17115 - protein, 108 aa, Mus musculus
DIQMTQPTSSLSASLGDTVTISCSASQDISNYLNWYQQKPDGTLKLLIYYTSSLHSGVPSRFSGSGSGTDYSLTISNLEPEDIATYYCQQFSKLPLTFGAGTKLELKR

SEQ ID NO: 17116 - protein, 112 aa, Mus musculus; identical to SEQ ID NO: 9059

SEQ ID NO: 17117 - protein, 111 aa, Mus musculus
NIVLTQSPASLAVSLGQRATISCRASESVDSYGRSFMHWYQQRPGQPPTLLIYLASNLESGVPVRFSGSGSRTDFTLTIDPVEADDAATYYCQQDNEDPYTFGGGTKLEIK

SEQ ID NO: 17118 - protein, 111 aa, Mus musculus
NIVLTQSPASLAVSLGQRATISCRASESVDSYGRSFMHWYQQRPGQPPTLLIYLASNLESGVPARFSGSGSRTDFTLTIDPVEADDAATYYCQQDNEDPYTFGGGTKLEIK

SEQ ID NO: 17119 - protein, 107 aa, Mus musculus
DIVLTQSPATLSVTPGDSVSLSCRASQSISKNLHWYQQKSHESPRLLIKYASQSISGIPSRFSGSGSGTDFTLSINSVETEDFGIYFCQQINSWPLTFGAGTKLELK

SEQ ID NO: 17120 - protein, 108 aa, Oryctolagus cuniculus
DMTQTPASVEVAVGGTVTIKCQASQNIGSNLAWYQQKPGQPPKLLIYKASTLASGVPSRFRGSGSGTEFTLAISDLECADAATYYCQQGYTTKDLVNPFGGGTEVVVK

SEQ ID NO: 17121 - protein, 108 aa, Oryctolagus cuniculus
DMTQTPASVEVAVGGTVTIKCQASQNIGSNLAWYQQKPGQPPKLLISKASTLASGVPSRFKGSGSGTEFTLAISDLECADAATYYCQQGYTTKNVVNPFGGGTEVVVK

SEQ ID NO: 17122 - protein, 108 aa, Oryctolagus cuniculus
DMIQTPASVEVAVGGTVTINCQASQNIGSNLAWYQQKPGQPPKLLIYGTSTLASGVSSRFKGSGFGTQFTFTISDVECTDAATYYCQQAYSISNVDNAFGGGTEVVVK

SEQ ID NO: 17123 - protein, 108 aa, Oryctolagus cuniculus
IVMTQTPSPVSGAVGGTVTINCQASQSIGSNLAWYQQKPGQPPKLLIYSASILASGAPSRVSGSGYGTEFTLTISGVQCADAATYYCQQGYTTNADNIFGGGTEVVVE

SEQ ID NO: 17124 - protein, 108 aa, Oryctolagus cuniculus
VMTQTPASVSGPVGGTVTIKCQASQSIGSNLGWYQQKPGQPPKLLIFSASNLESGVPSRFKGSGSGTQFTLTISDLECDDAATYYCQQGYTTNNVLNAFAGGTEVVVK

SEQ ID NO: 17125 - protein, 107 aa, Oryctolagus cuniculus
QMCLRHDPDSSLCGGSCGRHSHHQLPGQSEHWFSLVSAETRAASQAPDLWCIHSGIWGLIAVQRQWIWDTVHFHHQRRGVYRCCHLLLSTGICACRCFRRRDRDGGQ

SEQ ID NO: 17126 - protein, 108 aa, Oryctolagus cuniculus
DMIQTPASVEVAVGGTVTINCQASQSIGSNLAWYQQKPGQPPKLLIYGASTLASGVPSRFKGSGSGTQFTFTISDVECTAAATYYCQQAYSISNVDNAFGGGTEVVVK

SEQ ID NO: 17127 - protein, 108 aa, Oryctolagus cuniculus
DMTQTPASVEAAVGGTVTIKCQASQNIGSNLAWYQQKPGQRPKLLIYSASTLASGVPSRFKGSGSGTQFTLTISGVQCDDAATYYCQQGYSVGNVNNAFGGGTEVVVK

SEQ ID NO: 17128 - protein, 110 aa, Oryctolagus cuniculus
AYDMIQTPASVEVAVGGTVTINCQASQTIGTNLAWYQQKPGQRPKLLIYAASTLPSGVSSRFKGSGSGTQFTLTISDVECSDAATYYCQQAYSVGNVDNAFGGGTEVVVK

SEQ ID NO: 17129 - protein, 108 aa, Oryctolagus cuniculus
DMIQTPASVEVAVGGTVTINCQASQNIGSNLAWYQQKPGQPPKLLIYGTSTLASGVSSRFKGSGFGTQFTFTISDVECTDAATYYCQQAYSTSKIDNAFGGGTEVVVK

SEQ ID NO: 17130 - protein, 108 aa, Oryctolagus cuniculus
DMIQTPASVEVAVGGTVTINCQASQSIGSNLAWYQQKPGQPPKLLIYSASTLASGVSSRFKGSGSGTDYTLTISDVECTDAATYYCQQAYSISNVENPFGGGTEVVVK

SEQ ID NO: 17131 - protein, 108 aa, Oryctolagus cuniculus
DMTQTPASVEVAVGGTVTIKCQASQNIGYNLAWYQQKPGQPPKLLIYGASTLASGVPSRFKGSGSGTQFTLTISGVQCDDAATYYCQQGYSVSNIDNAFGGGTEVVVK

SEQ ID NO: 17132 - protein, 107 aa, Oryctolagus cuniculus
DMTQTPASVEAAVGGTVTIKCQASQSIGSYLSWYHQKPGQPPKLLIYRASTLASGVPSRFKGSGSGTQFTLTISDLECADAATYYCQQGYSANVDNAFGGGTEVVVK

SEQ ID NO: 17133 - protein, 108 aa, Oryctolagus cuniculus
DMTQTPASVSAAVGGTVTINCQASQSIGSNLGWYQQKPGQPPKLLIYGASTLASGVSSRFKGSGSGTHFAFTISDVECTDAATYYCQQAYSVGNVDNAFGGGTEVVVK

SEQ ID NO: 17134 - protein, 108 aa, Oryctolagus cuniculus
DMTQTPASVEVAVGGTVTIKCQASQSIGSNLAWYQQKPGQSPKLLIYSASILASGVPSRFKGSGSGTQFTLTISGVQCDDAATYYCQQGYSVGNIDNAFGGGTEVVVK

SEQ ID NO: 17135 - protein, 108 aa, Oryctolagus cuniculus
DMIQTPASVEVAVGGTVTINCQASQSIGSNLAWYQQKPGQPPKLLIYLASTLPSGVPSRFKGSGSGTQFTFTISDVECTDAATYYCQQAYTASNVDNAFGGGTEVVVK

SEQ ID NO: 17136 - protein, 111 aa, Oryctolagus cuniculus
IVMTQTPASVEAAVGGTVTIKCQASQNIYNYLAWYQQQPGQPPKLLIYSASNLASGVSSRFKGSGSGTEFTLTISDLECGDAATYYCQSYYDSSRISYGSAFGGGTEVVVK

SEQ ID NO: 17137 - protein, 108 aa, Oryctolagus cuniculus
DMTQTPASVEVAVGGTVTIKCQASQNIGSNLAWYQQKPGQPPKLLIYKASTLASGVPSRFRGSGSGTEFTLAISDLECADAATYYCQQGYTTKDVVNPFGGGTEVVVK

SEQ ID NO: 17138 - protein, 108 aa, Oryctolagus cuniculus
DMTQTPASVEAAVGGAVTIKCQASQNIGSNLAWYHQKPGQPPKLLISKASTLASGVPSRFKGSGSGTEFTLAISDLECADAATYYCQQGYTTKNVVNPFGGGTEVVVK

SEQ ID NO: 17139 - protein, 110 aa, Artificial Sequence
  Description of Artificial Sequence: Synthetic polypeptide
  Humanized VL rabbit antibody clone 408
DIQMTQSPSSLSASVGDRVTIKCQASQNIGSNLAWYQQKPGKPPKLLISKASTLASGVPSRFSGSGSGTDFTLTISSLQPEDFATYYCQQGYTTKNVVNPFGGGTKVEIK

SEQ ID NO: 17140 - protein, 108 aa, Oryctolagus cuniculus
DMTQTPASVEVAVGGTVTIKCQASQNIGSNLAWYQQKPGQRPKLLIYSASTLASGVPSRFKGSGSGTQFTLTISGVQCDDAATYYCQQGYSVGNVNNAFGGGTEVVVK

SEQ ID NO: 17141 - protein, 108 aa, Oryctolagus cuniculus
DMIQTPASVEVVVGGTVTFNCQASQNIGSNLAWYQQKPGQPPKLLIYSASTLASGVPSRFKGSGSGTQFTFTISDVECTDAATYYCQQAYSISNVDNAFGGGTEVVVK

SEQ ID NO: 17142 - protein, 108 aa, Oryctolagus cuniculus
DMIQTPASVEVGVGGTVTINCQASQNIGSNLAWYQQKPGQPPKFLIYGASTLASGVSSRFKGSGSGTRFTFTISDVECTDAATYYCQQAYSVGNVDNAFGGGTEVVVK

SEQ ID NO: 17143 - protein, 112 aa, Oryctolagus cuniculus
DIVMTQTPASVEAAVGGTVTIKCQASENIYNYLSWYQQKPGQPPKLLIYEASKLASGVSSRFKGSGSGTEFTLTISDLECADAATYYCQSYYDVTSHSYDNPFGGGTEVVVS

SEQ ID NO: 17144 - protein, 108 aa, Oryctolagus cuniculus
DMIQTPASVEVAVGGTVTINCQASQSIGSNLAWYQQKPGQRPKLLIYGASTLASGVSSRVKGSGSGTQFTFTISDVECTDAATYYCQQAYSISNVDNAFGGGTEVVVK

SEQ ID NO: 17145 - protein, 108 aa, Oryctolagus cuniculus
DMIQTPASVSEPVGGTVTINCQASQNIGSNLAWYQQKPGQPSKLLIYKASTLASGVPSRFKGSGSGTDFTLTISDLECADAATYYCQQAYTISNVDNAFGGGTEVVVK

SEQ ID NO: 17146 - protein, 108 aa, Oryctolagus cuniculus
DMIQTPASVEVAVGGTVTIGCQASQSIGSNLGWYQQKPGQPPKLLIYSASTLASGVSSRFKGSGSGTEFTLTISDVECDDAATYYCQQAYSVSNVDNAFGGGTEVVVK

SEQ ID NO: 17147 - protein, 108 aa, Oryctolagus cuniculus
DMTQTPASVEVAVGGTVTINCQASQNIGSNLAWYQQKPGQPPKLLIYGASTLASGVSSRFKGSGSGTQFTFTISDVECTDPATYYCQQAYSISNVDNPFGGGTEVVVK

SEQ ID NO: 17148 - protein, 108 aa, Oryctolagus cuniculus
DMTQTPASVEVAVGGTVTIKCQASQNIGSNLAWYQQKPGQPPKLLIYSTSTVASGVPSRFKGSGFGTQFTLTISGVQCDDAATYYCQQGYSAGNVNNPFGGGTEVVVK

SEQ ID NO: 17149 - protein, 109 aa, Oryctolagus cuniculus
DMTQTPASVSEPVGGTVTIKCQASQNIGSNLAWYQQKPGQRPKLLIYRASTLASGVSSRFKGSGSGTQFTLTISDLECADAATYYCQQGYSAGNVDNNTFGGGTEVVVK

SEQ ID NO: 17150 - protein, 109 aa, Oryctolagus cuniculus
DMTQTPASVSEPVGGTVTIKCQASQNIGSNLAWYQQKPGQRPKLLIYRASTLASGVSSRFKGSGSGTQFTLTISDLECADAATYYCQQGYSAGNVDKHVFGGGTEVVVK

SEQ ID NO: 17151 - protein, 108 aa, Oryctolagus cuniculus
DMIQTPASVSEPVGGTVTIVCQASQNIGSNFAWYQQKPGQPPKLLIYRASTLASGVSSRFKGSGFGTQFTLTISDLECADAATYYCQQGYSAGNVDNNFGGGTEVVVK

SEQ ID NO: 17152 - protein, 111 aa, Artificial Sequence
  Description of Artificial Sequence: Synthetic polypeptide
  Humanized VL rabbit antibody clone EBI51-22
DIQMTQSPSSLSASVGDRVTIKCQASQNIGSNLAWYQQKPGKRPKLLIYRASTLASGVPSRFSGSGSGTDFTLTISSLQPEDFATYYCQQGYSAGNVDNNAFGGGTKVEIK

SEQ ID NO: 17153 - protein, 109 aa, Oryctolagus cuniculus
DMTQTPASVSDPVGGTVTIKCQASQNIGSNLAWYQQKPGQRPKLLIYRASTLASGVSSRFKGSGSGTQFTLTISDLECADAATYYCQQGYSAGNVDNNAFGGGTEVVVK

SEQ ID NO: 17154 - protein, 108 aa, Oryctolagus cuniculus
DMTQTPASVEVAVGGTVTINCQASQNIGSNLAWYQQKPGQPPKLLIYKASTLASGVPSRLKGSGSGTEFTLTISGVQCDDAATYYCQQGYTTGNVDNPFGGGTEVVVK

SEQ ID NO: 17155 - protein, 108 aa, Oryctolagus cuniculus
DMTQTPASVSEPVGGTVTIKCQASQNIGSNLAWYQQKPGQRPKLLIYRASTLASGVSSRFKGSGSGTQFTLTISDLECADAATYYCQQGYSAGNVDNSFGGGTEVVVK

SEQ ID NO: 17156 - protein, 110 aa, Artificial Sequence
  Description of Artificial Sequence: Synthetic polypeptide
  Humanized VL rabbit antibody clone 23
DIQMTQSPSSLSASVGDRVTINCQASQSIGSNLAWYQQKPGKAPKLLIYAASTLPSGVSSRFSGSGSGTDFTLTINSLEAEDAATYYCQQAYSVGNVDNAFGGGTKVEIK

SEQ ID NO: 17157 - protein, 110 aa, Artificial Sequence
  Description of Artificial Sequence: Synthetic polypeptide
  Humanized VL rabbit anti-RANKL antibody clone 23
DIQMTQSPSSLSASVGDRVTINCQASQTIGTNLAWYQQKPGKRPKLLIYAASTLPSGVPSRFSGSGSGTDFTLTISSLQPEDFATYYCQQAYSVGNVDNAFGGGTKVEIK

SEQ ID NO: 17158 - protein, 110 aa, Artificial Sequence
  Description of Artificial Sequence: Synthetic polypeptide
  Humanized VL rabbit anti-RANKL antibody clone 23
DIQMTQSPSSLSASVGDRVTINCQASQSIGSNLAWYQQKPGKRPKLLIYAASTLPSGVPSRFSGSGSGTDFTLTISSLQPEDFATYYCQQAYSVGNVDNAFGGGTKVEIK

SEQ ID NO: 17159 - protein, 111 aa, Artificial Sequence
  Description of Artificial Sequence: Synthetic polypeptide
NIVLTQSPASLSVSLGQRATISCRASESVDSYGRSFMHWYQQRPGQAPRLLIYLASNLESGVPARFSGSGSRTDFTLTISSVEAEDEATYYCQQDNEDPYTFGGGTKLEIK

SEQ ID NO: 17160 - protein, 111 aa, Artificial Sequence
  Description of Artificial Sequence: Synthetic polypeptide
NIVLTQSPASLSVSLGQRATISCRASESVDSYGRSFMHWYQQRPGQAPKLLIYLASNLESGVPARFSGSGSRTDFTLTISSVEAEDEATYYCQQDNEDPYTFGGGTKLEIK

SEQ ID NO: 17161 - protein, 111 aa, Artificial Sequence
  Description of Artificial Sequence: Synthetic polypeptide
NIVLTQSPASLSVSLGQRATISCRASESVDSYGRSFMHWYQQKPGQAPKLLIYLASNLESGVPSRFSGSGSRTDFTLTISAVEAEDAATYYCQQDNEDPYTFGGGTKLEIK

SEQ ID NO: 17162 - protein, 111 aa, Artificial Sequence
  Description of Artificial Sequence: Synthetic polypeptide
NIVLTQSPASLSVSLGQRATISCRASESVDSYGRSFMHWYQQKPGQAPKLLIYLASNLESGVPSRFSGSGSRTDFTLTISRVEAEDAATYYCQQDNEDPYTFGGGTKLEIK

SEQ ID NO: 17163 - protein, 111 aa, Artificial Sequence
  Description of Artificial Sequence: Synthetic polypeptide
DIVMTQSPDSLAVSLGERATINCRASESVDSYGRSFMHWYQQKPGQAPRLLIYLASNLESGVPSRFSGSGSGTDFTLTINSLEAEDAATYYCQQDNEDPYTFGGGTKLEIK

SEQ ID NO: 17164 - protein, 108 aa, Artificial Sequence; identical to SEQ ID NO: 9397
  Description of Artificial Sequence: Synthetic polypeptide
  Synthetic alpha-RANKL-1 light chain variable region

SEQ ID NO: 17165 - protein, 108 aa, Artificial Sequence
  Description of Artificial Sequence: Synthetic polypeptide
EIVLTQSPGTLSLSPGERATLSCRASQSVRSNDLAWYQQKPGQAPRLLLYGASSRATGIPDRFSGSGSGTDFTLTISRLEPEDFVVYYCQQYGSSPRTFGQGTKVEMK

SEQ ID NO: 17166 - protein, 108 aa, Artificial Sequence
  Description of Artificial Sequence: Synthetic polypeptide
EIVLTQSPGTLSLSPGERATLSCRASQSVRSNDLAWYQQKPGQAPRLLLYGASSRATGIPDRFSGSGSGTDFTLTISRLEPEDFVVYYCQQYGSSPRTFGQGTKVEIK

SEQ ID NO: 17167 - protein, 108 aa, Artificial Sequence
  Description of Artificial Sequence: Synthetic polypeptide
EIVLTQSPGTLSLSPGERATLSCRASQSVRSNDLAWYQQKPGQAPRLLIYGASSRATGIPDRFSGSGSGTDFTLTISRLEPEDFAVYYCQQYGSSPRTFGQGTKVEIK

SEQ ID NO: 17168 - protein, 111 aa, Artificial Sequence
  Description of Artificial Sequence: Synthetic polypeptide
EIVMTQSPFSLPVTPGEPASISCRSSQNLLHSNGYNYLDWYLQKPGQSPQLLIYLGSNRASGVPDRFSGSGSGTDFTLKISRVEAEDVGVYYCMQALQTLTFGGGTKVEIR

SEQ ID NO: 17169 - protein, 111 aa, Artificial Sequence
  Description of Artificial Sequence: Synthetic polypeptide
DIVMTQSPFSLPVTPGEPASISCRSSQNLLHSNGYNYLDWYLQKPGQSPQLLIYLGSNRASGVPDRFSGSGSGTDFTLKISRVEAEDVGVYYCMQALQTLTFGGGTKVEIK

SEQ ID NO: 17170 - protein, 111 aa, Artificial Sequence
  Description of Artificial Sequence: Synthetic polypeptide
DIVMTQSPLSLPVTPGEPASISCRSSQNLLHSNGYNYLDWYLQKPGQSPQLLIYLGSNRASGVPDRFSGSGSGTDFTLKISRVEAEDVGVYYCMQALQTLTFGGGTKVEIK

SEQ ID NO: 17171 - protein, 111 aa, Artificial Sequence
  Description of Artificial Sequence: Synthetic polypeptide
DIVMTQSPLSLPVTPGEPASISCRSSQSLLHSNGNNYLDWYLHKPGQSPQLLIYLGSNRASGVPDRFSGSGSGTDFTLKISRVEAEDVGVYYCMQALQTLTFGGGTKVEIK

SEQ ID NO: 17172 - protein, 111 aa, Artificial Sequence
  Description of Artificial Sequence: Synthetic polypeptide
DIVMTQSPLSLPVTPGEPASISCRSSQSLLHSNGNNYLDWYLQKPGQSPQLLIYLGSNRASGVPDRFSGSGSGTDFTLKISRVEAEDVGVYYCMQALQTLTFGGGTKVEIK

SEQ ID NO: 17173 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLTFGGGTKVEIK

SEQ ID NO: 17174 - protein, 111 aa, Artificial Sequence
  Description of Artificial Sequence: Synthetic polypeptide
DIVMTQSPLSLPVTPGEPASISCRSSQSLLHSNGYKYLDWYLQKPGQSPQLLIYLGSNRASGVPDRFSGSGSGTDFTLKISRVEAEDVGVYYCMQALQTLTFGGGTKVEIK

SEQ ID NO: 17175 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLRISRVEAEDVGVYYCMQALQTLTFGGGTKVEIK

SEQ ID NO: 17176 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLQISRVEAEDVGVYYCMQALQTLSFGGGTKVEIK

SEQ ID NO: 17177 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLSFGGGTKVEIK

SEQ ID NO: 17178 - protein, 111 aa, Artificial Sequence
  Description of Artificial Sequence: Synthetic polypeptide
DIVMTQSPLSLPVSPGEPASISCRSSQSLLHSNGNNYLDWYLQKPGQSPQLLIYLGSNRASGVPDRFSGSGSGTDFTLKISRVEAEDVGVYYCMQALQTLTFGGGTKVEIK

SEQ ID NO: 17179 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGIYYCMQALQTLTFGGGTKVEIK

SEQ ID NO: 17180 - protein, 111 aa, Artificial Sequence
  Description of Artificial Sequence: Synthetic polypeptide
DIVMTQSPLSLPVTPGEPASISCRSSQSLLHNNGYNYLDWYLQKPGQSPHLLIYLGSNRASGVPDRFSGSGSGTDFTLKISRVAAEDVGVYYCMQALQTLTFGGGTKVEIK

SEQ ID NO: 17181 - protein, 111 aa, Artificial Sequence
  Description of Artificial Sequence: Synthetic polypeptide
DIVMTQSPLSLPVTPGEPASISCRSSQSLLHNNGYNYLDWYLQKPGQSPQLLIYLGSNRASGVPDRFSGSGSGTDFTLKISRVEAEDVGVYYCMQALQTLTFGGGTKVEIK

SEQ ID NO: 17182 - protein, 111 aa, Artificial Sequence
  Description of Artificial Sequence: Synthetic polypeptide
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLTFGGGTKVEIK

SEQ ID NO: 17183 - protein, 112 aa, Artificial Sequence
  Description of Artificial Sequence: Synthetic polypeptide
DLVMTQSPLSLPVTPGEPASISCRSSQSLLYSNGYNYLDWYLQKTGQSPQLLIYLGSNRASGVPDRFSGSGSGTDFTLKISRVEAEDVGVYYCMQALQTPHTFGQGTKLEIK

SEQ ID NO: 17184 - protein, 112 aa, Artificial Sequence
  Description of Artificial Sequence: Synthetic polypeptide
DIVMTQSPLSLPVTPGEPASISCRSSQSLLYSNGYNYLDWYLQKTGQSPQLLIYLGSNRASGVPDRFSGSGSGTDFTLKISRVEAEDVGVYYCMQALQTPHTFGQGTKLEIK

SEQ ID NO: 17185 - protein, 112 aa, Artificial Sequence
  Description of Artificial Sequence: Synthetic polypeptide
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPHTFGQGTKLEIK

SEQ ID NO: 17186 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLRISRVEAEDVGVYYCMQALQTLTFGGGTKVKIK

SEQ ID NO: 17187 - protein, 112 aa, Artificial Sequence
  Description of Artificial Sequence: Synthetic polypeptide
DIVMTQSPLSLSVTPGEPASISCRSSQSLLHSNGYNYLDWFLQKPGQSPQLLIYLGSNRASGVPDRFSGSGSGTDFTLKISRVEAEDVGVYYCMQPLQTPLTFGGGTKVEIK

SEQ ID NO: 17188 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTPLTFGGGTKVEIK

SEQ ID NO: 17189 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVAIYYCMQALQIPWTFGQGTKVEIK

SEQ ID NO: 17190 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQIPWTFGQGTKVEIK

SEQ ID NO: 17191 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASNLKSGVPSRFSGSGSGTEFTLTISSLQPDDFATYYCQQYNSYSWTFGQGTKVEIK

SEQ ID NO: 17192 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSWTFGQGTKVEIK

SEQ ID NO: 17193 - protein, 107 aa, Artificial Sequence
  Description of Artificial Sequence: Synthetic polypeptide
AIQMTQSPSTLSASVGDRVTITCRASQSISSWLAWYQQKPGKAPKLLIYKASSLESGVPSRFSGSGSGTEFTLTISSLQPDDFATYYCQQYNSYSWTFGQGTKVEIK

SEQ ID NO: 17194 - protein, 107 aa, Artificial Sequence
  Description of Artificial Sequence: Synthetic polypeptide
AIQMTQSPSTLSASVGDRVTITCRASRSINSWLAWYQQKPGKAPKLLIYKASSLESGVPSRFSGSGSGTEFTLTISSLQPDDFASYYCQQYNNYSWTFGQGTKVEIK

SEQ ID NO: 17195 - protein, 107 aa, Artificial Sequence
  Description of Artificial Sequence: Synthetic polypeptide
DIQMTQSPSTLSASVGDRVTITCRASRSINSWLAWYQQKPGKAPKLLIYKASSLESGVPSRFSGSGSGTEFTLTISSLQPDDFASYYCQQYNNYSWTFGQGTKVEIK

SEQ ID NO: 17196 - protein, 107 aa, Artificial Sequence
  Description of Artificial Sequence: Synthetic polypeptide
DIQMTQSPSTLSASVGDRVTITCRASRSINSWLAWYQQKPGKAPKLLIYKASSLESGVPSRFSGSGSGTEFTLTISSLQPDDFATYYCQQYNNYSWTFGQGTKVEIK

SEQ ID NO: 17197 - protein, 107 aa, Artificial Sequence
  Description of Artificial Sequence: Synthetic polypeptide
AIQMTQSPSTLSASVGDRVTITCRASQSISSWLAWYQQKTGKAPKLLIYKASSLESGVPSRFSGSGSGTEFTLTISSLQPDDFATYYCQQYNTYSWTFGQGTKVEIK

SEQ ID NO: 17198 - protein, 107 aa, Artificial Sequence
  Description of Artificial Sequence: Synthetic polypeptide
DIQMTQSPSTLSASVGDRVTITCRASQSISSWLAWYQQKTGKAPKLLIYKASSLESGVPSRFSGSGSGTEFTLTISSLQPDDFATYYCQQYNTYSWTFGQGTKVEIK

SEQ ID NO: 17199 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNTYSWTFGQGTKVEIK

SEQ ID NO: 17200 - protein, 107 aa, Artificial Sequence
  Description of Artificial Sequence: Synthetic polypeptide
DIQMTQSPSTLSASVGDRVTITCRASQSISNWLAWYQQKPGKAPKLLIYKASNLQSGVPSRFSGSGSGTEFTLTISSLQPDDFATYYCQQYNNYSWTFGQGTKVEIK

SEQ ID NO: 17201 - protein, 107 aa, Artificial Sequence
  Description of Artificial Sequence: Synthetic polypeptide
DIQMTQSPSTLSASVGDRVTITCRASQSISNWLAWYQQKPGKAPKLLIYKASSLESGVPSRFSGSGSGTEFTLTISSLQPDDFATYYCQQYNNYSWTFGQGTKVEIK

SEQ ID NO: 17202 - protein, 107 aa, Artificial Sequence
  Description of Artificial Sequence: Synthetic polypeptide
AIQMTQSPSTLSASVGDRVTITCRASQSISSWLAWYQLKPGKAPKLLIYKASSLESGVPSRFGGSGSGTEFTLTISSLQPDDFATYYCQHYNSYSWTFGQGTKVEIK

SEQ ID NO: 17203 - protein, 107 aa, Artificial Sequence
  Description of Artificial Sequence: Synthetic polypeptide
DIQMTQSPSTLSASVGDRVTITCRASQSISSWLAWYQLKPGKAPKLLIYKASSLESGVPSRFGGSGSGTEFTLTISSLQPDDFATYYCQHYNSYSWTFGQGTKVEIK

SEQ ID NO: 17204 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQHYNSYSWTFGQGTKVEIK

SEQ ID NO: 17205 - protein, 107 aa, Artificial Sequence
  Description of Artificial Sequence: Synthetic polypeptide
AIQMTQSPSTLSASVGDRVTITCRASQSIRSWLAWYQQKPGKAPKLLIYKASSLESGVPSRFSGSGSGTEFTLTISSLQPDDFATYYCQQYNSYLWTFGQGTKVEIK

SEQ ID NO: 17206 - protein, 107 aa, Artificial Sequence
  Description of Artificial Sequence: Synthetic polypeptide
DIQMTQSPSTLSASVGDRVTITCRASQSIRSWLAWYQQKPGKAPKLLIYKASSLESGVPSRFSGSGSGTEFTLTISSLQPDDFATYYCQQYNSYLWTFGQGTKVEIK

SEQ ID NO: 17207 - protein, 107 aa, Artificial Sequence
  Description of Artificial Sequence: Synthetic polypeptide
AIQMTQSPSTLSASVGDRVTITCRASQSISSWLAWYQQKPGKAPKLLIYKASSLESGVPSRFSGSGSGTEFTLTISSLQPDDFATYYCQHYNSYSWTFGQGTKVEIK

SEQ ID NO: 17208 - protein, 107 aa, Artificial Sequence
  Description of Artificial Sequence: Synthetic polypeptide
AIQMTQSPSTLSASVGDRVTITCRASQNIGNWLAWYQQKPGKAPKLLIYKASSLQNGVPSRFSGSGSGTEFTLTISSLQPDDFATYYCQRYNSYSWTFGQGTKVEIK

SEQ ID NO: 17209 - protein, 107 aa, Artificial Sequence
  Description of Artificial Sequence: Synthetic polypeptide
DIQMTQSPSTLSASVGDRVTITCRASQNIGNWLAWYQQKPGKAPKLLIYKASSLQNGVPSRFSGSGSGTEFTLTISSLQPDDFATYYCQRYNSYSWTFGQGTKVEIK

SEQ ID NO: 17210 - protein, 107 aa, Artificial Sequence
  Description of Artificial Sequence: Synthetic polypeptide
DIQMTQSPSTLSASVGDRVTITCRASQNIGNWLAWYQQKPGKAPKLLIYKASSLESGVPSRFSGSGSGTEFTLTISSLQPDDFATYYCQRYNSYSWTFGQGTKVEIK

SEQ ID NO: 17211 - protein, 107 aa, Artificial Sequence
  Description of Artificial Sequence: Synthetic polypeptide
AIQMTQSPSTLSASVGDRVTITCRASQNISSWLAWYQQKPGKAPKLLIYKASSLESGVPSRFSGSGSGTEFTLTVSSLQPDDFATYYCQQYNRYSWTFGQGTKVEIK

SEQ ID NO: 17212 - protein, 107 aa, Artificial Sequence
  Description of Artificial Sequence: Synthetic polypeptide
DIQMTQSPSTLSASVGDRVTITCRASQNISSWLAWYQQKPGKAPKLLIYKASSLESGVPSRFSGSGSGTEFTLTVSSLQPDDFATYYCQQYNRYSWTFGQGTKVEIK

SEQ ID NO: 17213 - protein, 107 aa, Artificial Sequence
  Description of Artificial Sequence: Synthetic polypeptide
DIQMTQSPSTLSASVGDRVTITCRASQNISSWLAWYQQKPGKAPKLLIYKASSLESGVPSRFSGSGSGTEFTLTISSLQPDDFATYYCQQYNRYSWTFGQGTKVEIK

SEQ ID NO: 17214 - protein, 107 aa, Artificial Sequence
  Description of Artificial Sequence: Synthetic polypeptide
DIQMTQSPSTLSASVGDRVTITCRASQTISSWLAWYQQKPGKAPKLLIYKASSLESGVPSRFSGSGSGTEFTLTISSLQPDDFATYYCQQYNSYSWTFGQGTKVDIK

SEQ ID NO: 17215 - protein, 107 aa, Artificial Sequence
  Description of Artificial Sequence: Synthetic polypeptide
DIQMTQSPSTLSASVGDRVTITCRASQTISSWLAWYQQKPGKAPKLLIYKASSLESGVPSRFSGSGSGTEFTLTISSLQPDDFATYYCQQYNSYSWTFGQGTKVEIK

SEQ ID NO: 17216 - protein, 108 aa, Artificial Sequence
  Description of Artificial Sequence: Synthetic polypeptide
EIVLTQSPATLSLSPGERATLSCRASQSIRSWLAWYQQKPGQAPRLLIYKASNRATGIPARFSGSGSGTDFTLTISSLEPEDFGVYYCQQYNSYLWTFGGGTKVEIKR

SEQ ID NO: 17217 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTVSSLQPDDFATYYCQQYNRYSWTFGQGTKVEIK

SEQ ID NO: 17218 - protein, 107 aa, Artificial Sequence
  Description of Artificial Sequence: Synthetic polypeptide
  RON-e01 murine VL
DIQMTQSPSSLSASLGERVSLTCRASQDIGSSLSWLQQEPDGTIKRLIYSTSSLDSGVPKRFSGSRSGSDYSLTISSLESEDFVDYYCLQYASSPWTFGGGTKLEIK

SEQ ID NO: 17219 - protein, 107 aa, Artificial Sequence
  Description of Artificial Sequence: Synthetic polypeptide
  RON-e01h6 humanized VL
AIQLTQSPSSLSASVGDRVTITCRASQDIGSSLSWLQQKPGKAPKRLIYSTSSLDSGVPSRFSGSGSGTDFTLTISSLQPEDFATYYCLQYASSPWTFGQGTKVEIK

SEQ ID NO: 17220 - protein, 107 aa, Artificial Sequence
  Description of Artificial Sequence: Synthetic polypeptide
  RON-e01h7 humanized VL
DIQMTQSPSSLSASVGDRVTITCRASQDIGSSLSWLQQKPGKAPKRLIYSTSSLDSGVPSRFSGSGSGTDYTLTISSLQPEDFATYYCLQYASSPWTFGQGTKVEIK

SEQ ID NO: 17221 - protein, 107 aa, Artificial Sequence
  Description of Artificial Sequence: Synthetic polypeptide
  RON-f01 murine VL
DIQMTQSPASQSASLGESVTITCLASQTIGTWLAWYQQKPGKSPQLLIYAATSLADGVPSRFSASGSGTKFSFKIDSLQSEDFVSYYCQQLYNTPWTFGGGTKLEIK

SEQ ID NO: 17222 - protein, 107 aa, Artificial Sequence
  Description of Artificial Sequence: Synthetic polypeptide
  RON-f01h2 humanized VL; hu4C04 VL
DIQMTQSPSSLSASVGDRVTITCLASQTIGTWLAWYQQKPGKAPKLLIYAATSLADGVPSRFSGSGSGTDFTLTISSLQPEDFATYYCQQLYNTPWTFGGGTKVEIK

SEQ ID NO: 17223 - protein, 113 aa, Artificial Sequence
  Description of Artificial Sequence: Synthetic polypeptide
  Chimeric light chain sequence
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSYPLTFGQGTKVEIK

SEQ ID NO: 17224 - protein, 113 aa, Artificial Sequence; identical to SEQ ID NO: 14300
  Description of Artificial Sequence: Synthetic polypeptide
  Chimeric light chain sequence

SEQ ID NO: 17225 - protein, 147 aa, Mus musculus
MDLQVQIFSFLLISASVIMSRGENVLTQSPVIMSASPGEKVTMTCSASSSLSYIHWYQQKSRTSPKLWIYDTSNLASGVPGRFSGSGSGNSYSLTISSMEAEDVATYYCFQGSEYPLTFGGGTKLEMTRADAAPTVSIFPPSSKLGK

SEQ ID NO: 17226 - protein, 108 aa, Artificial Sequence
  Description of Artificial Sequence: Synthetic polypeptide
  2F11; VL
EIVLTQSPGTLSLSPGERATLSCRASQSVSSSYLAWYQQKPGQAPRLLIYGASSRATGVPDRFSGSGSGTDFTLTISRLEPEDFAVYYCQQGQYTPPTFGQGTKVEIK

SEQ ID NO: 17227 - protein, 108 aa, Artificial Sequence
  Description of Artificial Sequence: Synthetic polypeptide
  2F11(VI); VL
EIVLTQSPGTLSLSPGERATLSCRASQSVSSSYLAWYQQKPGQAPRLLIYGASSRATGIPDRFSGSGSGTDFTLTISRLEPEDFAVYYCQQGQYTPPTFGQGTKVEIK

SEQ ID NO: 17228 - protein, 107 aa, Artificial Sequence
  Description of Artificial Sequence: Synthetic polypeptide
  2B10; VL
DIQMTQSPSSLSASVGDRVTITCRASQGIRNDLGWYQQKPGKAPKRLIYAASSLQSGVPSRFSGGGSGTEFTLTISSLQPEDFATYYCLQNGLQPATFGQGTKVEIK

SEQ ID NO: 17229 - protein, 107 aa, Artificial Sequence
  Description of Artificial Sequence: Synthetic polypeptide
  2B10(GS); 2B10_C3B6; 2B10_6A12; VL
DIQMTQSPSSLSASVGDRVTITCRASQGIRNDLGWYQQKPGKAPKRLIYAASSLQSGVPSRFSGSGSGTEFTLTISSLQPEDFATYYCLQNGLQPATFGQGTKVEIK

SEQ ID NO: 17230 - protein, 107 aa, Artificial Sequence
  Description of Artificial Sequence: Synthetic polypeptide
  2B10_6H10; VL
DIQMTQSPSSLSASVGDRVTITCRASQGIRNVLGWYQQKPGKAPKRLIQAATSLQSGVPSRFSGGGSGTEFTLTISSLQPEDFATYYCLQNGLQPATFGQGTKVEIK

SEQ ID NO: 17231 - protein, 107 aa, Artificial Sequence
  Description of Artificial Sequence: Synthetic polypeptide
  2B10_C3A6; VL
DIQMTQSPSSLSASVGDRVTITCRASQGIRNVLGWYQQKPGKAPKRLIYDSSSLQSGVPSRFSGGGSGTEFTLTISSLQPEDFATYYCLQNGLQPATFGQGTKVEIK

SEQ ID NO: 17232 - protein, 107 aa, Artificial Sequence
  Description of Artificial Sequence: Synthetic polypeptide
  2B10_D1A2_VD; VL
DIQMTQSPSSLSASVGDRVTITCRASQGIRNDLGWYQQKPGKAPKRLIYDAYSLQSGVPSRFSGGGSGTEFTLTISSLQPEDFATYYCLQNGLQPATFGQGTKVEIK

SEQ ID NO: 17233 - protein, 107 aa, Artificial Sequence
  Description of Artificial Sequence: Synthetic polypeptide
  2B10_D1A2_wt; VL
DIQMTQSPSSLSASVGDRVTITCRASQGIRNVLGWYQQKPGKAPKRLIYDAYSLQSGVPSRFSGGGSGTEFTLTISSLQPEDFATYYCLQNGLQPATFGQGTKVEIK

SEQ ID NO: 17234 - protein, 107 aa, Artificial Sequence
  Description of Artificial Sequence: Synthetic polypeptide
  2B10_O1F7; VL
DIQMTQSPSSLSASVGDRVTITCRASQGIRNVLGWYQQKPGKAPKRLIYDASSLQSGVPSRFSGGGSGTEFTLTISSLQPEDFATYYCLQNGLQPATFGQGTKVEIK

SEQ ID NO: 17235 - protein, 107 aa, Artificial Sequence
  Description of Artificial Sequence: Synthetic polypeptide
  2B10_O7D8; VL
DIQMTQSPSSLSASVGDRVTITCRASQSIRNVLGWYQQKPGKAPKRLIYDVSSLQSGVPSRFSGGGSGTEFTLTISSLQPEDFATYYCLQNGLQPATFGQGTKVEIK

SEQ ID NO: 17236 - protein, 108 aa, Homo sapiens
  New 4A1-F16 and 3A1-D5 VL domain amino acid sequence
SELTQDPAVSVALGQTVRITCQGDSLRSYYASWYQQKPGQAPVLVIYGKNNRPSGIPDRFSGSSSGNTASLTITGAQAEDEADYYCNSSVYTMPPVVFGGGTKLTVLG

SEQ ID NO: 17237 - protein, 109 aa, Homo sapiens
  E10 and A12 VL domain amino acid sequence
SSELTQDPAVSVALGQTVRITCQGDSLRSYYASWYQQKPGQAPVLVIYGKNNRPSGIPDRFSGSSSGNTASLTITGAQAEDEADYYCNSSHGPRRPVVFGGGTKLTVLG

SEQ ID NO: 17238 - protein, 108 aa, Homo sapiens
  New E10 and A12 VL domain amino acid sequence
SELTQDPAVSVALGQTVRITCQGDSLRSYYASWYQQKPGQAPVLVIYGKNNRPSGIPDRFSGSSSGNTASLTITGAQAEDEADYYCNSSHGPRRPVVFGGGTKLTVLG

SEQ ID NO: 17239 - protein, 108 aa, Artificial Sequence
  Description of Artificial Sequence: Synthetic polypeptide
  Synthetic sequence: F16 and 4A1-F16 VL domain
SSELTQDPAVSVALGQTVRITCQGDSLRSYYASWYQQKPGQAPVLVIYGKNNRPSGIPDRFSGSSSGNTASLTITGAQAEDEADYYCNSSVYTMPPVVFGGGTKLTVL

SEQ ID NO: 17240 - protein, 108 aa, Homo sapiens
  New F4 VL domain amino acid sequence
SELTQDPAVSVALGQTVRITCQGDSLRLYYASWYQQKPGQAPVLVIYGKSSRPSGIPDRFSGSSSGNTASLTITGAQAEDEADYYCNSSHGPRRPVVFGGGTKLTVLG

SEQ ID NO: 17241 - protein, 109 aa, Homo sapiens
  F4 VL domain amino acid sequence
SSELTQDPAVSVALGQTVRITCQGDSLRLYYASWYQQKPGQAPVLVIYGKSSRPSGIPDRFSGSSSGNTASLTITGAQAEDEADYYCNSSHGPRRPVVFGGGTKLTVLG

SEQ ID NO: 17242 - protein, 109 aa, Homo sapiens
  F4S VL domain amino acid sequence
SSELTQDPAVSVALGQTVRITCQGDSLRSYYASWYQQKPGQAPVLVIYGKNNRPSGIPDRFSGSSSGNTASLTITGAQAEDEADYYCNSFSPKPKPVVFGGGTKLTVLG

SEQ ID NO: 17243 - protein, 108 aa, Homo sapiens
  New G11 VL domain amino acid sequence
SELTQDPAVSVALGQTVRITCQGDSLRLYYASWYQQKPGQAPVLVIYGKNNRPSGIPDRFSGSSSGNTASLTITGAQAEDEADYYCNSSHGPRRPVVFGGGTKLTVLG

SEQ ID NO: 17244 - protein, 109 aa, Homo sapiens
  G11 VL domain amino acid sequence
SSELTQDPAVSVALGQTVRITCQGDSLRLYYASWYQQKPGQAPVLVIYGKNNRPSGIPDRFSGSSSGNTASLTITGAQAEDEADYYCNSSHGPRRPVVFGGGTKLTVLG

SEQ ID NO: 17245 - protein, 109 aa, Homo sapiens
  P12 and D11 VL domain amino acid sequence
SSELTQDPAVSVALGQTVRITCQGDSLRRQPASWYQQKPGQAPVLVIYYKKLRPSGIPDRFSGSSSGNTASLTITGAQAEDEADYYCNSFSPKPKPVVFGGGTKLTVLG

SEQ ID NO: 17246 - protein, 108 aa, Artificial Sequence
  Description of Artificial Sequence: Synthetic polypeptide
  Synthetic amino acid sequence of antibody G10 - VL
SELTQDPAVSVALGQTVRITCQGDSLRSYYASWYQQKPGQAPVLVIYGKNNRPSGIPDRFSGSSSGNTASLTITGAQAEDEADYYCNSSGSQRSPVVFGGGTKLTVLG

SEQ ID NO: 17247 - protein, 142 aa, Artificial Sequence
  Description of Artificial Sequence: Synthetic polypeptide
  synthetic ST2146 light chain variable region protein sequence
MRCLAEFLGLLVLWIPGAIGDIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPLTFGAGTKLELKRADAAPTVSI

SEQ ID NO: 17248 - protein, 138 aa, Mus musculus
MGWSWIFLFLLSGTAGVHSEVQLQQSGPELVKPGASMKISCKASGYSFTGYTMNWVKQSHGKNLEWIGLINPHNGGTTYNQKFKGKATLTVDKSSNTAYMELLSLTSEDSAVYYCTRPGGYYWFFDVWGAGTTVTVSS

SEQ ID NO: 17249 - protein, 111 aa, Homo sapiens
DIVMTQSPLSLPVTPGEPASISCRTSQSLLQSNGYNYLDWYLQKPGQSPQLLIYLGSSRASGVPDRFSGSGSGTDFTLKISRVEAEDVGVYYCMQALQTLTFGGGTKVEIK

SEQ ID NO: 17250 - protein, 108 aa, Homo sapiens
EIVLTQFPGTLSLSPGESAPLSCRASQSVSSIDLVWYQQKPGQAPRLLIYGASSRATGIPDRFSVSGSGTDFTLTISRLEPEDFAVYYCQQYGSSPFTFGPGTKVDIK

SEQ ID NO: 17251 - protein, 106 aa, Homo sapiens
QIVMTQSPATLSVSPGERATLSCRASQSVSSNLAWYQQKPGQAPRLLIYGASTRATGIPARFSGSGSGTEFTLTISSLQSEDFAVYYCQQYNKWWTFGQGTKVEIK

SEQ ID NO: 17252 - protein, 112 aa, Homo sapiens
DIVMTQSPLSLPVTPGEPASISCRSSQSLLHSNGYNYLDWYLQKPGQSPQFLIYLGSNRASGVPDRFSGSGSGTDFTLKISRVEAEDVGVYYCMQALQTPITFGQGTRLEIK

SEQ ID NO: 17253 - protein, 113 aa, Homo sapiens
DIVMTQSPDSLAVSLGERATVNCKSSQSVLYRSNNKNYLAWYHQKPGQPPKMLISWASTRESGVPDRFSGSGSGTDFTLTISSLQAEDVAVYYCQQYYSTPITFGQGTRLEIK

SEQ ID NO: 17254 - protein, 108 aa, Homo sapiens
EIVLTQSPGTLSLSPGERATLSCRASQSVSSRYLAWYQQKPGQAPRLLIYGASSRATGIPDRFSGSGSGTDFTLTISRLEPEDFAEYYCQQYGRSPFTFGAGTKVDIK

SEQ ID NO: 17255 - protein, 108 aa, Homo sapiens
EIVLTQSPGTLSLSPGERATLSCRASQSVISSYLAWYQQKPGQAPRLLIYNASNRATGIPDRFSGSGSGTDFTLTISRLEPEDFAVYYCQQYGSSPITFGQGTRLEIK

SEQ ID NO: 17256 - protein, 108 aa, Homo sapiens
EIVLTQSPGTLSLSPGERATFSCRASQSVISNYLAWYQQKPGQAPRLLIYNTSSRATGIPGRFSGGGSGTDFTLTITRLEPEDFAVYYCQQYGSSPITFGQGTRLEIK

SEQ ID NO: 17257 - protein, 112 aa, Homo sapiens
DIVMTQSPLSLPVTPGEPASISCRSSQSLLHSIGYNYLDWYLQKPGQSPQLLIYLGSNRASGVPDRFSGSGSGTDFTLKISRVEAEDVGIYYCMQALQTPLTFGGGTKVEIK

SEQ ID NO: 17258 - protein, 112 aa, Homo sapiens
DIVMTQTPLSLSVTPGQPASISCKSSQSLLHSDRQTYLFWYLQKPGQPPQLLIYEVSNRFSGVPDRFSGSGSGTDFTLKISRVEAEDVGVYYCMQSIQLPPTFGPGTKVDIK

SEQ ID NO: 17259 - protein, 107 aa, Homo sapiens
DIQLTQSPSSLSASVGDRVTITCRASQDISNYLAWYQQKPGKVPKLLIYAASTLQSGVPSRFSGSGSGTDFTLTISSLQPEDIATYSCQKYSSTPFTFGPGTKVDIK

SEQ ID NO: 17260 - protein, 107 aa, Homo sapiens
DIQMTQSPSSLSASVGDRVTITCRASQSINSYLNWYQQKPGKAPRLLIYAASNLQSGVPSRFSGSGSGTDFTLTISSLQPEDFSTYYCQQSHNTPLTFGGGTKVEIK

SEQ ID NO: 17261 - protein, 107 aa, Homo sapiens
DIQMTQSPSSLSASVGDRVTITCRASQSISSYLNWYQQKPGKAPNLLIYTASSLQSGVPSRFSGSGSGTVFTLTISSLQPEDFATYYCQQSSSTPFTFGPGTKVDFK

SEQ ID NO: 17262 - protein, 114 aa, Artificial Sequence
  Description of Artificial Sequence: Synthetic polypeptide
  Synthetic Construct
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKR

SEQ ID NO: 17263 - protein, 112 aa, Artificial Sequence
  Description of Artificial Sequence: Synthetic polypeptide
  Synthetic Construct
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVK

SEQ ID NO: 17264 - protein, 106 aa, Artificial Sequence
  Description of Artificial Sequence: Synthetic polypeptide
  3H4 light chain
QIVLTQSPAIMSASPGEKVTITCSASSSVSYMHWFQQKPGTSPKLWIYSTSNLASGVPARFSGSGSGTSYSLTISRMEAEDAATYYCQQRSSYPFTFGSGTKLEIK

SEQ ID NO: 17265 - protein, 113 aa, Artificial Sequence
  Description of Artificial Sequence: Synthetic polypeptide
  Synthetic sequence: 5E5VK
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 17266 - protein, 113 aa, Artificial Sequence
  Description of Artificial Sequence: Synthetic polypeptide
  Synthetic sequence: Humanized antibody light chain variable  region 5E5RKA
DIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIK

SEQ ID NO: 17267 - protein, 113 aa, Artificial Sequence
  Description of Artificial Sequence: Synthetic polypeptide
  Synthetic sequence: Humanized antibody light chain variable  region 5E5RKA1
DIVMTQSPDSLAVSLGERATIICKSSQSLLNSGDQKNYLTWYQQKPGQPPKLLIFWASTRESGVPDRFTGSGSGTDFTLTISSLQAEDVAVYYCQNDYSYPLTFGQGTKVEIK

SEQ ID NO: 17268 - protein, 113 aa, Artificial Sequence
  Description of Artificial Sequence: Synthetic polypeptide
  Synthetic sequence: Humanized antibody light chain variable  region 5E5RKB
DIVMTQSPLSLPVTPGEPASISCKSSQSLLNSGDQKNYLTWYLQKPGQSPQLLIYWASTRESGVPDRFSGSGSGTDFTLKISRVEAEDVGVYYCQNDYSYPLTFGGGTKVEIK

SEQ ID NO: 17269 - protein, 113 aa, Artificial Sequence
  Description of Artificial Sequence: Synthetic polypeptide
  Synthetic sequence: Humanized antibody light chain variable   region 5E5RKB1
DIVMTQSPLSLPVTPGEPASIICKSSQSLLNSGDQKNYLTWYLQKPGQSPQLLIFWASTRESGVPDRFTGSGSGTDFTLKISRVEAEDVGVYYCQNDYSYPLTFGGGTKVEIK

SEQ ID NO: 17270 - protein, 113 aa, Artificial Sequence
  Description of Artificial Sequence: Synthetic polypeptide
  5E5 light chain
ELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 17271 - protein, 108 aa, Artificial Sequence
  Description of Artificial Sequence: Synthetic polypeptide
  antibody
DIQMTQTTSSLSASLGDRVIISCSASQDISNYLNWYQQKPDGTVKVLIYFTSSLHSGVPSRFSGSGSGTDYSLTISNLEPEDIATYYCQQYSTVPWTFGGGTKLEIKR

SEQ ID NO: 17272 - protein, 108 aa, Artificial Sequence; identical to SEQ ID NO: 14389
  Description of Artificial Sequence: Synthetic polypeptide
  antibody

SEQ ID NO: 17273 - protein, 112 aa, Artificial Sequence
  Description of Artificial Sequence: Synthetic polypeptide
  Synthetic VL sequence of 1P2D10.1
DIVMSQSPSSLAVSAGEKVTLSCKSSQSLLNSRSRKNYLAWYQQKPGQSPKLLISWASTRESGVPDRFTGSGSGTDFTLTISSVQAEDLAVYYCKQSYNLYTFGGGTKLEIK

SEQ ID NO: 17274 - protein, 107 aa, Artificial Sequence
  Description of Artificial Sequence: Synthetic polypeptide
  Synthetic VL sequence of 1P5B10.2
DIQMTQTTSSLSASLGDRVTISCRASQDISNHLNWYQQKPDGTVKLLIYYTSTLHSGVPSRFSGSGSGTDYSLTISNLEPEDIATYYCQQDLNLPWTFGGGTKLEIK

SEQ ID NO: 17275 - protein, 107 aa, Artificial Sequence
  Description of Artificial Sequence: Synthetic polypeptide
  Synthetic VL sequence of M59-B05
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 17276 - protein, 107 aa, Artificial Sequence
  Description of Artificial Sequence: Synthetic polypeptide
  Synthetic VL sequence of M61-C02
DIQMTQSPATLSLSPGERATLSCRASQSVSSYLAWYQQKPGQAPRLLIYSASTRATGIPARFSGSGSGTEFTLTISSLQSEDFAVYYCQQSNDWPLTFGGGTKVEIK

SEQ ID NO: 17277 - protein, 113 aa, Artificial Sequence
  Description of Artificial Sequence: Synthetic polypeptide
  Synthetic VL sequence of M61-C03
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 17278 - protein, 107 aa, Artificial Sequence
  Description of Artificial Sequence: Synthetic polypeptide
  Synthetic VL sequence of M65-A11
DIQMTQSPSFLSASVGDRVTITCRASQGISSYLAWYQQKPGKAPKLLIYAASTLQSGVPSRFSGSGSGTEFTLTISSLQPEDFATYYCQQANSFSITFGQGTRVDNK

SEQ ID NO: 17279 - protein, 107 aa, Artificial Sequence
  Description of Artificial Sequence: Synthetic polypeptide
  Synthetic VL sequence of M66-H09
DIQMTQSPATLSLSPGERATLSCRASQSVSSYLAWYQQKPGQAPRLLIYDASNRATGIPARFSGSGSGTDFTLTITSLQPEDFAAYYCQQSYTTPITFGQGTRLDIK

SEQ ID NO: 17280 - protein, 107 aa, Artificial Sequence
  Description of Artificial Sequence: Synthetic polypeptide
  Synthetic VL sequence of M67-F05
DIQMTQSSSSLSASVGDRVTITCRASQRIGTYLNWYQQKPGKAPKLLLYTASRLQSGVPPTFSGSGSETDFTLTISSLQPEDFATYYCQQTYTTPPTFGQGTIVEIK

SEQ ID NO: 17281 - protein, 149 aa, Mus musculus
  light chain variable region (1A7)
MKLPVRLLVLMFWIPASSDDVFMTQTPLSLPVSLGDQASISCRSSQSIVHSNGNTYLEWYLQKPGQSPNLLIYFVSNRFSGVPDRFSGSGSGTDFTLKISRVEAEDLGVYYCFQGSHVPWTFGGGTKLEIKRADAAPTVSIFPPSSKLG

SEQ ID NO: 17282 - protein, 131 aa, Artificial Sequence
  Description of Artificial Sequence: Synthetic polypeptide
  Light Chain Variable Domain of BR55-2 Murine IgG3
MKLPVRLLVLMFWIPASSSDVLMTQTPLSLPVSLGDQASISCRSSQSIVHSNGNTYLEWYLQKPGQSPKLLISKVSNRFSGVPDRFSGSGSGTDFTLKISRVEAEDLGVYYCFQGSHVPFTFGSGTKLEIK

SEQ ID NO: 17283 - protein, 112 aa, Artificial Sequence
  Description of Artificial Sequence: Synthetic polypeptide
  humanized light chain variable region
DIVMTQSPLSLPVTPGEPASISCRSSQSIVHSNGNTYLEWYLQKPGQSPQLLISKVSNRFSGVPDRFSGSGSGTDFTLKISRVEAEDVGVYYCFQGSHVPFTFGQGTKLEIK

SEQ ID NO: 17284 - protein, 112 aa, Artificial Sequence
  Description of Artificial Sequence: Synthetic polypeptide
  humanized BR55-2,light chain
DIVMTQSPLSLPVTPGEPASISCRSSQSLLHSDGFDYLNWYLQKPGQSPQLLIYALSNRASGVPDRFSGSGSGTDFTLKISRVEAEDVGVYYCMQALQAPITFGQGTRLEIK

SEQ ID NO: 17285 - protein, 111 aa, Artificial Sequence
  Description of Artificial Sequence: Synthetic polypeptide
DVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 17286 - protein, 111 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHYLTFGSGTKLEIK

SEQ ID NO: 17287 - protein, 108 aa, Mus musculus; identical to SEQ ID NO: 12653

SEQ ID NO: 17288 - protein, 108 aa, Mus musculus; identical to SEQ ID NO: 12654

SEQ ID NO: 17289 - protein, 107 aa, Mus musculus; identical to SEQ ID NO: 13190

SEQ ID NO: 17290 - protein, 120 aa, Homo sapiens
TQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKRTVAAPSVFIF

SEQ ID NO: 17291 - protein, 104 aa, Artificial Sequence
  Description of Artificial Sequence: Synthetic polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 17292 - protein, 108 aa, Artificial Sequence; identical to SEQ ID NO: 16929
  Description of Artificial Sequence: Synthetic polypeptide
  Murine KM666 VL (light chain variable region) sequence

SEQ ID NO: 17293 - protein, 140 aa, Mus sp.
  MB3.6 Heavy chain V region, plus leader
MNFGFSLIFLVLVLKGVQCEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSS

SEQ ID NO: 17294 - protein, 107 aa, Homo sapiens
  light chain variable region
DIQMTQSPSSLSASVGDRVTITCRASQDIGNFLNWYQQKPGKAPKLLIYYTSRLQSGVPSRFSGSGSGTDYTLTISSLQPEDFATYYCQQGKTLPYTFGGGTKVEIK

SEQ ID NO: 17295 - protein, 107 aa, Homo sapiens
  light chain variable region
DIQMTQSPSSLSASVGDRVTITCRASQDIGNFLNWYQQKPGKAPKLLLYYTSRLQSGVPSRFSGSGSGTDYTLTISSLQPEDFATYYCQQGKTLPYTFGGGTKVEIK

SEQ ID NO: 17296 - protein, 128 aa, Mus musculus
MMSSAQFLGLLLLCFQGTRCDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKR

SEQ ID NO: 17297 - protein, 106 aa, Artificial Sequence
  Description of Artificial Sequence: Synthetic polypeptide
  BW2121 light chain variable region
DIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEI

SEQ ID NO: 17298 - protein, 107 aa, Artificial Sequence
  Description of Artificial Sequence: Synthetic polypeptide
  KM641 light chain variable region
DIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIK

SEQ ID NO: 17299 - protein, 108 aa, Artificial Sequence
  Description of Artificial Sequence: Synthetic polypeptide
  MB3.6 light chain variable region
DIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKR

SEQ ID NO: 17300 - protein, 107 aa, Artificial Sequence
  Description of Artificial Sequence: Synthetic polypeptide
  R24 light chain variable region
DIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIK

SEQ ID NO: 17301 - protein, 133 aa, Artificial Sequence
  Description of Artificial Sequence: Synthetic polypeptide
  chimeic human antibody
MHFQVQIFSFLLISASVIMSRGDIQLTQSPSSLSASVGDRVTITCSASSSVSYMHWYQQKPGKAPKLLIYSTSNLASGVPSRFSGSGSGTDFTFTISSLQPEDIATYYCQQRSSYPYTFGGGTKVEIKRTVAA

SEQ ID NO: 17302 - protein, 108 aa, Artificial Sequence; identical to SEQ ID NO: 13948
  Description of Artificial Sequence: Synthetic polypeptide
  Amino Acid Sequence of Antibody Light Chain Variable Region

SEQ ID NO: 17303 - protein, 108 aa, Artificial Sequence; identical to SEQ ID NO: 13949
  Description of Artificial Sequence: Synthetic polypeptide
  Amino Acid Sequence of Antibody Light Chain Variable Region

SEQ ID NO: 17304 - protein, 108 aa, Artificial Sequence; identical to SEQ ID NO: 13953
  Description of Artificial Sequence: Synthetic polypeptide
  Amino Acid Sequence of Antibody Light Chain Variable Region

SEQ ID NO: 17305 - protein, 128 aa, Homo sapiens; identical to SEQ ID NO: 8051

SEQ ID NO: 17306 - protein, 128 aa, Homo sapiens; identical to SEQ ID NO: 8052

SEQ ID NO: 17307 - protein, 128 aa, Homo sapiens; identical to SEQ ID NO: 8053

SEQ ID NO: 17308 - protein, 128 aa, Homo sapiens; identical to SEQ ID NO: 8054

SEQ ID NO: 17309 - protein, 107 aa, Artificial Sequence; identical to SEQ ID NO: 14408
  Description of Artificial Sequence: Synthetic polypeptide
  immunoglobulin light chain

SEQ ID NO: 17310 - protein, 108 aa, Artificial Sequence; identical to SEQ ID NO: 13197
  Description of Artificial Sequence: Synthetic polypeptide
  immunoglobulin light chain

SEQ ID NO: 17311 - protein, 109 aa, Artificial Sequence
  Description of Artificial Sequence: Synthetic polypeptide
  immunoglobulin light chain
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRT

SEQ ID NO: 17312 - protein, 109 aa, Artificial Sequence; identical to SEQ ID NO: 14284
  Description of Artificial Sequence: Synthetic polypeptide
  immunoglobulin light chain

SEQ ID NO: 17313 - protein, 112 aa, Artificial Sequence [sequence omitted]

SEQ ID NO: 17314 - protein, 112 aa, Artificial Sequence [sequence omitted]

SEQ ID NO: 17315 - protein, 100 aa, Artificial Sequence
  Description of Artificial Sequence: Synthetic polypeptide
LTTAPGGTVILTCRSSTGAVTTNNYANWVQEKPDHLFTGLIDATSNRVPGVPVRFSGSLIGDKAALTITGAQTEDDAMYFCALWYNTHFVFGGGTKVTVL

SEQ ID NO: 17316 - protein, 114 aa, Artificial Sequence
  Description of Artificial Sequence: Synthetic polypeptide
  Light chain variable region of BR96
DVLMTQIPVSLPVSLGDQASISCRSSQIIVHNNGNTYLEWYLQKPGQSPQLLIYKVSNRFSGVPDRFSGTGSGTDFTLKISRVEAEDLGVYYCFQGSHVPFTFGSGTKLEIKRA

SEQ ID NO: 17317 - protein, 112 aa, Artificial Sequence
  Description of Artificial Sequence: Synthetic polypeptide
  BW835 VL
DIVMTQTPPSVPVTPGESVSISCRSSQSLLHGDGNTYLYWFLQRPGQSPRLLIYRMSNLASGVPDRFSGSGSGTAFTLRISRVEAEDVGVYYCMQHLEYPFTFGGGTKVEIK

SEQ ID NO: 17318 - protein, 107 aa, Mus musculus
  light chain variable region of 14F7
DIVLTQSPATLSVTPGDSVSFSCRASQSISNNLHWYQQRTHESPRLLIKYASQSISGIPSRFSGSGSGTDFTLSIIAVETEDFGMYFCQQSNRWPLTFGAGTKLELK

SEQ ID NO: 17319 - protein, 111 aa, Artificial Sequence
  Description of Artificial Sequence: Synthetic polypeptide
  light chain variable region (clone 2Am)
DIVMFQSPASLAVSLGQRATISCRASQSVSSSSYSYMHWYQQKPGQPPKLLIKYASNLESGVPARFSGSGSGTDFTLNIHPVEEEDAATYYCQHSRDVPLTFGAGTKLEIK

SEQ ID NO: 17320 - protein, 107 aa, Artificial Sequence
  Description of Artificial Sequence: Synthetic polypeptide
  light chain variable region (clone3Fm)
DIQMTQTPSSLSASLGDRVTISCRASQDISNYLNWYQQKPDGTVKLLIVYTSRLHSGVPSRFSGSGSGTDYSLTISNLEQEDIATYFCQQGNTLPPTFGAGTKLELK

SEQ ID NO: 17321 - protein, 107 aa, Artificial Sequence
  Description of Artificial Sequence: Synthetic polypeptide
  light chain variable region (clone 7BhK)
DIQMTQTPSSLSASVGDRVTITCRASQSISSFLNWYQQKPGKAPKLLIYAASNLGSGVPSRFSGRGSGTDFTLTISSLQPEDFAAYYCQQGYTTPLTFGQGTKLELK

SEQ ID NO: 17322 - protein, 110 aa, Artificial Sequence
  Description of Artificial Sequence: Synthetic polypeptide
  light chain variable region (clone 7Ahl)
QSVVTQPPSASGGPGQSLTISCTGTSSDVGGYNHVSWYQQHPGKAPKLMIYDVSKRPSGVPHRFSGSKSGNTASLTVSGLQAEDEAVYYCSSYAGSNNLVFGGGTKVTVL

SEQ ID NO: 17323 - protein, 108 aa, Artificial Sequence
  Description of Artificial Sequence: Synthetic polypeptide
  light chain variable region (clone 8Bhl)
SSELTQDPAVSVALGQTVRITCQGDSLRSYYASWYQQKPGQAPVLYIYGKNNRPSGIPDRFSGSSSGNTASLTITGAQAEDEADYYCNSRDSSGNHVVFGGGTKLTVL

SEQ ID NO: 17324 - protein, 133 aa, Mus musculus
  light chain variable region
MKLPVRLLVLMFWIPGSSSDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLELKRT

SEQ ID NO: 17325 - protein, 94 aa, Artificial Sequence
  Description of Artificial Sequence: Synthetic polypeptide
  Variable Light Chain - Clone AE8
GGTVKITCSGGGGSYYGWFQQKSPGSAPVTVIYDNTNRPSNIPSRFSGSLSGSTNTLTITGVQAEDEAVYYCGSYDRSAGYVGIFGAGTTLTVL

SEQ ID NO: 17326 - protein, 89 aa, Artificial Sequence
  Description of Artificial Sequence: Synthetic polypeptide
  Variable Light Chain - Clone AE9
GGTVKITCSGGGGSYYGWFQQKSPGSAPVTVIYDNTNRPSNIPSRFSGSKSGSTGTLTITVQAEDEAVYYCGNFDTSAIFGAGTTLTVL

SEQ ID NO: 17327 - protein, 90 aa, Artificial Sequence
  Description of Artificial Sequence: Synthetic polypeptide
  Variable Light Chain - Clone CD3
GGTVEITCSGGSYSYGWYQQKSPGSAPVTVIYQNTNRPSDIPSRFSGSKSGSTGTLTITGVRAEDEAVYYCGSFDSSVGMFGAGTTLTVL

SEQ ID NO: 17328 - protein, 79 aa, Artificial Sequence
  Description of Artificial Sequence: Synthetic polypeptide
  Variable Light Chain - Clone CD11
KWYGWYQQKAPGSAPVTLIYDNTNRPSDIPSRFSGSASGSTATLTITGVQVEDEAVYFGGYDGSTDAGIFGAGTTLTVL

SEQ ID NO: 17329 - protein, 130 aa, Artificial Sequence
  Description of Artificial Sequence: Synthetic polypeptide
  VL chain domain of clone 5B1
MAGFPLLLTLLTHCAGSWAQSVLTQPPSASGTPGQRVTISCSGSSSNIGSNFVYWYQQLPGTAPKLLIYRNNQRPSGVPDRFSGSRSGTSASLAISGLRSEDEADYYCAAWDDSLGGHYVFGTGTKVTVL

SEQ ID NO: 17330 - protein, 129 aa, Artificial Sequence
  Description of Artificial Sequence: Synthetic polypeptide
  VL chain domain of clone 9H3
MAGFPLLLTLLTHCAGSWAQSVLTQPPSASGTPGQRVTISCSGSSSNIGSNYVYWYQQLPGTAPKLLIYRNNQRPSGVPDRFSGSKSGTSASLAISGLRSEDEADYYCAAWDASLSGVVFGGGTKLTVL

SEQ ID NO: 17331 - protein, 130 aa, Artificial Sequence
  Description of Artificial Sequence: Synthetic polypeptide
  VL chain domain of clone 5H11
MAGFPLLLTLLTHCAGSWAQSVLTQPPSASGTPGQRVTISCSGSSSNIGSNYVYWYQQVPGTAPKLLIYRNNQRPSGVPDRFSGSKSGTSASLAISGLRSEDEADYYCAAWDDSLSGHYVFGTGTKVTVL

SEQ ID NO: 17332 - protein, 130 aa, Artificial Sequence
  Description of Artificial Sequence: Synthetic polypeptide
  VL chain domain of clone 7E3
MDMRVPAQLLGLLLLWLRGARCEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIK

SEQ ID NO: 17333 - protein, 109 aa, Artificial Sequence
  Description of Artificial Sequence: Synthetic polypeptide
  Synthetic consensus sequence
  MOD_RES (2)..(2): Ser or Tyr
  MOD_RES (65)..(65): Ser or Thr
  MOD_RES (69)..(69): Ser or Thr
  MOD_RES (88)..(88): Asn, Glu or Met
  MOD_RES (92)..(92): Trp, Val, Thr, Ser, His, Tyr, Asn or Ala
  MOD_RES (95)..(95): Asn or Asp
  MOD_RES (96)..(96): Gln, Lys, His, Ser, Val, Arg, Thr or Asn
  MOD_RES (108)..(108): Leu or Ile
SXELTQDPAVSVALGQTVRITCQGDSLRSYYASWYQQKPGQAPVLVIYGKNNRPSGIPDRFSGSXSGNXASLTITGAQAEDEADYYCXSRDXPGXXWVFGGGTKVTVXG

SEQ ID NO: 17334 - protein, 107 aa, Artificial Sequence
  Description of Artificial Sequence: Synthetic polypeptide
  Synthetic consensus sequence
  MOD_RES (4)..(4): Leu or Met
  MOD_RES (51)..(51): Arg, Ser, Lys, Ala, Gly, Gln, Thr, Asn, Pro or Asp
  MOD_RES (54)..(54): Arg, Leu, Cys, Thr, Pro, Gly, Ser, Lys, Glu, Gln, His, Ala, Tyr or Ile
  MOD_RES (70)..(70): Glu or Asp
  MOD_RES (84)..(84): Ala or Gly
  MOD_RES (93)..(93): Thr, Ala, Arg, Met, Phe, Ser, Asn, Trp, Gln, Leu or Val
  MOD_RES (94)..(94): Trp or Phe
DIQXTQSPSSLSASLGDRVTITCRASQGISSYLAWYQQKPGKAPKLLIYAXSTXQSGVPSRFSGSGSGTXFTLTISSLQPEDSXTYYCQQYWXXPLTFGGGTKVEIK

SEQ ID NO: 17335 - protein, 233 aa, Mus musculus; identical to SEQ ID NO: 12656

SEQ ID NO: 17336 - protein, 233 aa, Mus musculus; identical to SEQ ID NO: 12927

SEQ ID NO: 17337 - protein, 209 aa, Mus musculus; identical to SEQ ID NO: 12655

SEQ ID NO: 17338 - protein, 334 aa, Artificial Sequence; identical to SEQ ID NO: 14396
  Description of Artificial Sequence: Synthetic polypeptide
  Synthetic construct

SEQ ID NO: 17339 - protein, 334 aa, Artificial Sequence; identical to SEQ ID NO: 14395
  Description of Artificial Sequence: Synthetic polypeptide
  Synthetic construct

SEQ ID NO: 17340 - protein, 234 aa, Artificial Sequence
  Description of Artificial Sequence: Synthetic polypeptide
  73R009 Light chain amino acid sequence with predicted signal sequence
MKHLWFFLLLVAAPRWVLSDIVLTQSPATLSASPGEKVTLTCSASSSVSSSYLYWYQQKPGQAPKLLIYSTSNLASGVPARFSGSGSGTSYSLTISSLEPEDFATYYCHQWSSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17341 - protein, 215 aa, Artificial Sequence
  Description of Artificial Sequence: Synthetic polypeptide
  73R009 Light chain amino acid sequence without predicted signal sequence
DIVLTQSPATLSASPGEKVTLTCSASSSVSSSYLYWYQQKPGQAPKLLIYSTSNLASGVPARFSGSGSGTSYSLTISSLEPEDFATYYCHQWSSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17342 - protein, 110 aa, Artificial Sequence
  Description of Artificial Sequence: Synthetic polypeptide
  VL domain
  MOD_RES (23)..(23): Arg, Asn, Asp, Glu, Gln or His
QSVLTQPPSASGTPGQRVTISCXGSLSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17343 - protein, 110 aa, Artificial Sequence
  Description of Artificial Sequence: Synthetic polypeptide
  VL domain
  MOD_RES (25)..(25): His, Asn, Thr, Asp, Arg, Leu, Phe or Tyr
QSVLTQPPSASGTPGQRVTISCSGXLSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17344 - protein, 110 aa, Artificial Sequence
  Description of Artificial Sequence: Synthetic polypeptide
  VL domain
  MOD_RES (26)..(26): Ile, Met, Phe or Tyr
QSVLTQPPSASGTPGQRVTISCSGSXSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17345 - protein, 110 aa, Artificial Sequence
  Description of Artificial Sequence: Synthetic polypeptide
  VL domain
  MOD_RES (23)..(23): Arg, Asn, Glu, Gln, His or Lys
  MOD_RES (25)..(25): His, Asn, Thr, Asp, Arg, Leu, Phe or Tyr
QSVLTQPPSASGTPGQRVTISCXGXLSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17346 - protein, 110 aa, Artificial Sequence
  Description of Artificial Sequence: Synthetic polypeptide
  VL domain
  MOD_RES (23)..(23): Arg, Asn, Glu, Gln, His or Lys
  MOD_RES (26)..(26): Ile, Met, Phe or Tyr
QSVLTQPPSASGTPGQRVTISCXGSXSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17347 - protein, 110 aa, Artificial Sequence
  Description of Artificial Sequence: Synthetic polypeptide
  VL domain
  MOD_RES (25)..(25): His, Asn, Thr, Asp, Arg, Leu, Phe or Tyr
  MOD_RES (26)..(26): Ile, Met, Phe or Tyr
QSVLTQPPSASGTPGQRVTISCSGXXSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17348 - protein, 110 aa, Artificial Sequence
  Description of Artificial Sequence: Synthetic polypeptide
  VL domain
  MOD_RES (23)..(23): Arg, Asn, Asp, Glu, Gln, His or Lys
  MOD_RES (25)..(25): His, Asn, Thr, Asp, Arg, Leu, Phe or Tyr
  MOD_RES (26)..(26): Ile. Met, Phe or Tyr
QSVLTQPPSASGTPGQRVTISCXGXXSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 17349 - protein, 110 aa, Artificial Sequence
  Description of Artificial Sequence: Synthetic polypeptide
  VL domain
  MOD_RES (70)..(70): Asn, His, Tyr, Lys or Arg
  MOD_RES (71)..(71): Asn or Tyr
QSVLTQPPSASGTPGQRVTISCSGSLSNIGLNYVSWYQQLPGTAPKLLISRNNQRPSGVPDRFSGSKSGXXASLAISGLRSEDEADYYCAAWDDSPPGEAFGGGTKLTVL

SEQ ID NO: 17350 - protein, 110 aa, Artificial Sequence
  Description of Artificial Sequence: Synthetic polypeptide
  VL domain
  MOD_RES (51)..(51): Phe, Tyr, His, Ala, Leu, Ile or Val
QSVLTQPPSASGTPGQRVTISCSGSLSNIGLNYVSWYQQLPGTAPKLLISXNNQRPSGVPDRFSGSKSGTSASLAISGLRSEDEADYYCAAWDDSPPGEAFGGGTKLTVL

SEQ ID NO: 17351 - protein, 110 aa, Artificial Sequence
  Description of Artificial Sequence: Synthetic polypeptide
  VL domain
  MOD_RES (31)..(31): Ser, Ala, Gly or Val
  MOD_RES (51)..(51): Phe, Tyr, His, Ala, Leu, Ile or Val
QSVLTQPPSASGTPGQRVTISCSGSLSNIGXNYVSWYQQLPGTAPKLLISXNNQRPSGVPDRFSGSKSGTSASLAISGLRSEDEADYYCAAWDDSPPGEAFGGGTKLTVL

SEQ ID NO: 17352 - protein, 110 aa, Artificial Sequence
  Description of Artificial Sequence: Synthetic polypeptide
  VL domain
  MOD_RES (31)..(31): Ser, Ala, Gly or Val
QSVLTQPPSASGTPGQRVTISCSGSLSNIGXNYVSWYQQLPGTAPKLLISRNNQRPSGVPDRFSGSKSGTSASLAISGLRSEDEADYYCAAWDDSPPGEAFGGGTKLTVL

SEQ ID NO: 17353 - protein, 110 aa, Artificial Sequence
  Description of Artificial Sequence: Synthetic polypeptide
  VL domain
  MOD_RES (33)..(33): Tyr, Phe, Ile, Val, Leu or Ala
QSVLTQPPSASGTPGQRVTISCSGSLSNIGLNXVSWYQQLPGTAPKLLISRNNQRPSGVPDRFSGSKSGTSASLAISGLRSEDEADYYCAAWDDSPPGEAFGGGTKLTVL

SEQ ID NO: 17354 - protein, 105 aa, Artificial Sequence [sequence omitted]

SEQ ID NO: 17355 - protein, 103 aa, Artificial Sequence
  Description of Artificial Sequence: Synthetic polypeptide
  lambda LC constant region
KAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 17356 - protein, 104 aa, Artificial Sequence
  Description of Artificial Sequence: Synthetic polypeptide
  kappa LC constant region, C105del
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 17357 - protein, 101 aa, Artificial Sequence
  Description of Artificial Sequence: Synthetic polypeptide
  lambda LC constant region, C102 and S103del
KAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTE

SEQ ID NO: 17358 - protein, 105 aa, Artificial Sequence
  Description of Artificial Sequence: Synthetic polypeptide
  kappa LC constant region, C105S
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGES

SEQ ID NO: 17359 - protein, 105 aa, Artificial Sequence
  Description of Artificial Sequence: Synthetic polypeptide
  kappa LC constant region, C105V
VAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEV

SEQ ID NO: 17360 - protein, 103 aa, Artificial Sequence
  Description of Artificial Sequence: Synthetic polypeptide
  lambda LC constant region, C102S
KAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTESS

SEQ ID NO: 17361 - protein, 103 aa, Artificial Sequence
  Description of Artificial Sequence: Synthetic polypeptide
  lambda LC constant region, C102V
KAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEVS

SEQ ID NO: 17362 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17363 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17364 - protein, 513 aa, Artificial Sequence; identical to SEQ ID NO: 17363
  Description of Artificial Sequence: Synthetic polypeptide

SEQ ID NO: 17365 - protein, 513 aa, Artificial Sequence; identical to SEQ ID NO: 17362
  Description of Artificial Sequence: Synthetic polypeptide

SEQ ID NO: 17366 - protein, 513 aa, Artificial Sequence; identical to SEQ ID NO: 17362
  Description of Artificial Sequence: Synthetic polypeptide

SEQ ID NO: 17367 - protein, 513 aa, Artificial Sequence; identical to SEQ ID NO: 15187
  Description of Artificial Sequence: Synthetic polypeptide

SEQ ID NO: 17368 - protein, 513 aa, Artificial Sequence; identical to SEQ ID NO: 15187
  Description of Artificial Sequence: Synthetic polypeptide

SEQ ID NO: 17369 - protein, 513 aa, Artificial Sequence; identical to SEQ ID NO: 15187
  Description of Artificial Sequence: Synthetic polypeptide

SEQ ID NO: 17370 - protein, 513 aa, Artificial Sequence; identical to SEQ ID NO: 15187
  Description of Artificial Sequence: Synthetic polypeptide

SEQ ID NO: 17371 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17372 - protein, 513 aa, Artificial Sequence; identical to SEQ ID NO: 17371
  Description of Artificial Sequence: Synthetic polypeptide

SEQ ID NO: 17373 - protein, 513 aa, Artificial Sequence; identical to SEQ ID NO: 17371
  Description of Artificial Sequence: Synthetic polypeptide

SEQ ID NO: 17374 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17375 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17376 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17377 - protein, 513 aa, Artificial Sequence; identical to SEQ ID NO: 17376
  Description of Artificial Sequence: Synthetic polypeptide

SEQ ID NO: 17378 - protein, 513 aa, Artificial Sequence; identical to SEQ ID NO: 17376
  Description of Artificial Sequence: Synthetic polypeptide

SEQ ID NO: 17379 - protein, 513 aa, Artificial Sequence; identical to SEQ ID NO: 17376
  Description of Artificial Sequence: Synthetic polypeptide

SEQ ID NO: 17380 - protein, 533 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 17381 - protein, 512 aa, Artificial Sequence
  Description of Artificial Sequence: Synthetic polypeptide
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 17382 - protein, 511 aa, Artificial Sequence
  Description of Artificial Sequence: Synthetic polypeptide
MQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 17383 - protein, 513 aa, Artificial Sequence
  Description of Artificial Sequence: Synthetic polypeptide
MQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 17384 - protein, 521 aa, Artificial Sequence
  Description of Artificial Sequence: Synthetic polypeptide
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 17385 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17386 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17387 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17388 - protein, 506 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLEEGEFSEARVDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17389 - protein, 498 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLGGDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17390 - protein, 509 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSSSTGGGGSGGGGSGGGGSDIQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17391 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17392 - protein, 506 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLEEGEFSEARVDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17393 - protein, 498 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLGGDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17394 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17395 - protein, 509 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSSSTGGGGSGGGGSGGGGSDIQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17396 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17397 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17398 - protein, 506 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLEEGEFSEARVDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17399 - protein, 498 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAKTTPKLGGDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17400 - protein, 509 aa, Artificial Sequence
  Description of Artificial Sequence: Synthetic polypeptide
EFATMAVMAPRTLVLLLSGALALTQTWAGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSSSTGGGGSGGGGSGGGGSDIQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17401 - protein, 261 aa, Artificial Sequence
  Description of Artificial Sequence: Synthetic polypeptide
EFATMAVMAPRTLVLLLSGALALTQTWAGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17402 - protein, 261 aa, Artificial Sequence; identical to SEQ ID NO: 17401
  Description of Artificial Sequence: Synthetic polypeptide

SEQ ID NO: 17403 - protein, 261 aa, Artificial Sequence; identical to SEQ ID NO: 17401
  Description of Artificial Sequence: Synthetic polypeptide

SEQ ID NO: 17404 - protein, 509 aa, Artificial Sequence; identical to SEQ ID NO: 17390
  Description of Artificial Sequence: Synthetic polypeptide

SEQ ID NO: 17405 - protein, 502 aa, Artificial Sequence
  Description of Artificial Sequence: Synthetic polypeptide
EFATMAVMAPRTLVLLLSGALALTQTWAGDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSGGGGSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQNVFSCSVMHEALHNHYTQKSLSLSPGK

SEQ ID NO: 17406 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17407 - protein, 261 aa, Artificial Sequence
  Description of Artificial Sequence: Synthetic polypeptide
EFATMAVMAPRTLVLLLSGALALTQTWAGEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17408 - protein, 260 aa, Artificial Sequence
  Description of Artificial Sequence: Synthetic polypeptide
EFATMAVMAPRTLVLLLSGALALTQTWAGEPKSSDKTHTCPPCPAPELLGGPSVFLFPPKPKDTLMISRTPEVCVVVDVSHEDPEVKFNWYVDGVEVHNAKTKPREEQYNSTYRVVSVLTVLHQDWLNGKEYKCKVSNKALPAPIEKTISKAKGQPREPQVYTYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17409 - protein, 261 aa, Artificial Sequence; identical to SEQ ID NO: 17407
  Description of Artificial Sequence: Synthetic polypeptide

SEQ ID NO: 17410 - protein, 506 aa, Artificial Sequence; identical to SEQ ID NO: 15286
  Description of Artificial Sequence: Synthetic polypeptide

SEQ ID NO: 17411 - protein, 503 aa, Artificial Sequence; identical to SEQ ID NO: 15287
  Description of Artificial Sequence: Synthetic polypeptide

SEQ ID NO: 17412 - protein, 503 aa, Artificial Sequence; identical to SEQ ID NO: 15288
  Description of Artificial Sequence: Synthetic polypeptide

SEQ ID NO: 17413 - protein, 492 aa, Artificial Sequence
  Description of Artificial Sequence: Synthetic polypeptide
  (scFV)2 CD3-MCSP polypeptide
DIVLTQSPSSLSASLGDRVTISCSASQGIRNYLNWYQQRPDGTVKLLIYYTSSLHSGVPSRFSGSGSGTDYSLTISNLEPEDIATYYCQQYSKLPWTFGGGTKLEIKGGGGSGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSVEGGSGGSGGSGGSGGVDDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKHHHHHH

SEQ ID NO: 17414 - protein, 264 aa, Homo sapiens
MKYLLPTAAAGLLLLAAQPAMAEVQLVESGGGLVQPGGSLRLSCAASGFSLTNYGVHWVRQAPGKGLEWLGVIWSGGNTDYNTPFTSRFTISRDNSKNTLYLQMNSLRAEDTAVYYCARALTYYDYEFAYWGQGTTVTVSSGGGGSGGGGSGGGGSDIQLTQSPSFLSASVGDRVTITCRASQSIGTNIHWYQQKPGKAPKLLIKYASESISGVPSRFSGSGSGTEFTLTISSLQPEDFATYYCQQNNNWPTTFGAGTKLEIKR

SEQ ID NO: 17415 - protein, 479 aa, Artificial Sequence
  Description of Artificial Sequence: Synthetic polypeptide
  Amino Acid Sequence of the Mature Fusion Protein Human 14.18 sFv (VL-VH)-Fc
DVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKSGGGGSGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17416 - protein, 241 aa, Artificial Sequence
  Description of Artificial Sequence: Synthetic polypeptide
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 17417 - protein, 249 aa, Artificial Sequence
  Description of Artificial Sequence: Synthetic polypeptide
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSSGSTSGSGKPGSSEGSTKGDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 17418 - protein, 244 aa, Artificial Sequence
  Description of Artificial Sequence: Synthetic polypeptide
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGSTSGSGKPGSSEGSTKGDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 17419 - protein, 243 aa, Artificial Sequence
  Description of Artificial Sequence: Synthetic polypeptide
  Murine KM666 sequence
QVQLKESGPVLVAPSQTLSITCTVSGFSLASYNIHVWRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 17420 - protein, 242 aa, Artificial Sequence
  Description of Artificial Sequence: Synthetic polypeptide
  Humanised KM666 sequence
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKR

SEQ ID NO: 17421 - protein, 243 aa, Artificial Sequence
  Description of Artificial Sequence: Synthetic polypeptide
  Murine KM666 sequence
QVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 17422 - protein, 265 aa, Homo sapiens
MKYLLPTAAAGLLLLAAQPAMAEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGTGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 17423 - protein, 248 aa, Artificial Sequence
  Description of Artificial Sequence: Synthetic polypeptide
  Single-chain antibody fusion protein of B3 monoclonal antibody Variable Heavy chain (VH) and Variable Light chain (VL) Fv region joined by a (Gly-4Ser)-3 peptide linker
MDVKLVESGGGLVQPGGSLKLSCATSGFTFSDYYMYWVRQTPEKRLEWVAYISNDDSSAAYSDTVKGRFTISRDNARNTLYLQMSRLKSEDTAIYSCARGLAWGAWFAYWGQGTLVTVSSGGGGSGGGGSGGGGSDVLMTQSPLSLPVSLGDQASISCRSSQIIVHSNGNTYLEWYLQKPGQSPKLLIYKVSNRFSGVPDRFSGSGSGTDFTLKISRVEAEDLGVYYCFQGSHVPFTFGSGTKLEIKA

SEQ ID NO: 17424 - protein, 192 aa, Artificial Sequence
  Description of Artificial Sequence: Synthetic polypeptide
  Clone AE8 scFv
GGTVKITCSGGGGSYYGWFQQKSPGSAPVTVIYDNTNRPSNIPSRFSGSLSGSTNTLTITGVQAEDEAVYYCGSYDRSAGYVGIFGAGTTLTVLGQSSRSSAVTLDESGGGLQTPGGGLSLVCKASGFTFDSYAMYWVRQAPGKGLEWVASINRFGSSTGHGAAVKGRATISRDNGQSTLGAYPYDVPDYAS

SEQ ID NO: 17425 - protein, 249 aa, Artificial Sequence
  Description of Artificial Sequence: Synthetic polypeptide
  Clone AE9 scFv
GGTVKITCSGGGGSYYGWFQQKSPGSAPVTVIYDNTNRPSNIPSRFSGSKSGSTGTLTITVQAEDEAVYYCGNFDTSAIFGAGTTLTVLGQSSRSSAVTLDESGGGLQTPGGALSLICKASGFTFSSFNMIWVRQAPGKGLEFVGSINRFGNSTGHGAAVKGRVTISRDDGQSTVRLQLNNLRAEDTGTYFCAKSVHGHCASGYWCSAASIDAWGHGTEVIVSSTSGQAGQHHHHHHGAYPYDVPDYAS

SEQ ID NO: 17426 - protein, 245 aa, Artificial Sequence
  Description of Artificial Sequence: Synthetic polypeptide
  Clone CD3 scFv
GGTVEITCSGGSYSYGWYQQKSPGSAPVTVIYQNTNRPSDIPSRFSGSKSGSTGTLTITGVRAEDEAVYYCGSFDSSVGMFGAGTTLTVLGQSSRSSAVTLDESEGGLQTPGGALSLVCKASGFSFSDRGMHWVRQAPGKGLEYVAGIYDDGGTTYYGAAVKGRASITRDNGQSAVRLQLNNLRAEDTATYYCAKSAAGDAWGADDIDAWGHGTEVIVSSTSGQAGQHHHHHHGAYPYDVPDYAS

SEQ ID NO: 17427 - protein, 240 aa, Artificial Sequence
  Description of Artificial Sequence: Synthetic polypeptide
  Clone CD11 scFv
KWYGWYQQKAPGSAPVTLIYDNTNRPSDIPSRFSGSASGSTATLTITGVQVEDEAVYFCGGYDGSTDAGIFGAGTTLTVLGQSSRSSAVTLDESGGGLQTPGGALSLVCKASGFDFSSYQMNWIRQAPGKGLEWVAAINKFGTSTSRGAAVKGRVTISRDDGQSTVRLQLNNLRSEDTATYFCAKSAYGSCASGSWCSAASIDAWGHGTEVIVSSTSGQAGQHHHHHHGAYPYDVPDYAS

SEQ ID NO: 17428 - protein, 260 aa, Artificial Sequence
  Description of Artificial Sequence: Synthetic polypeptide
MAQVQLLESGGGLVQPGGSLRLSCAASGFTVSSNYMHWVRQAPGKGLEWVSAINSNGDSTYYPDTVKDRFTISRDNSKNTLYLQMNSLRAEDTAVYYCARCHLYDLGSHPPYYFDFWGQGTLVTVSSGSAGGGGSGGGGSGGGGSDIVLTQSPGTLSLSPGERATLSCRASQSVSSGYLAWYQQKPGQAPRLLIYAASSRATGIPDRFSGSGSGTDFTLTISRLEPEDFAVYYCQQYYGSPWTFGQGTKLEIKAAADYKD

SEQ ID NO: 17429 - protein, 250 aa, Artificial Sequence
  Description of Artificial Sequence: Synthetic polypeptide
MAEVQLLESGGGLVQPGGSLRLSCAASGFTAWPSVVTEGLGGPGGGSARLQARGWSGFHHLQRQFQEHAVSANEQPESRGHAVYYCARDPDPYGSESFRLFGTFDYWGQGTLVTVSSGSAGGGGSGGGGSGGGGSDIVLTQSPGTLSLSPGERATLSCRASQSVTSSSLAWYQQKPGQAPRLLIYGASARATGIPDRFSGSGSGTDFTLTISRLEPEDFAVYYCQQYYDWPLTFGGGTKLEIKAAADYKD

SEQ ID NO: 17430 - protein, 247 aa, Artificial Sequence
  Description of Artificial Sequence: Synthetic polypeptide
MAEVQLLESGGGLVQPGGSLRLSCAASGFTFSEYGMNWVRQAPGKGLEWVSGISWNSDTIDYGDSVKGRFTISRDNSKNTLYLQMNSLRAEDTAVYYCARRQYYAMDVWGPGTLVTVSSGSAGGGGSGGGGSGGGGSDIVLTQPPSASGTPGQRVTISCSGNSGSIASNSVQWYQQLPGKAPKLLIYDNDKRPSGVPDRFSGSKSGTSASLAISGLRSEDEADYYCSSYTSSSTLVVFGGGTKLTVL

SEQ ID NO: 17431 - protein, 251 aa, Artificial Sequence
  Description of Artificial Sequence: Synthetic polypeptide
MAEVQLLESGGGLVQPGGSLRLSCAASGFTVISGDMGWVRQAPGKGLEWVSAITTGGGSPNYADSVKGRFTISRDNSKNTLYLQMNSLRAEDTAVYYCARDEGMVGATYFDHWGQGTLVTVSSGSAGGGGSGGGGSGGGGSDIVLTQPPSASGTPGQRVTISCSGSNSNIGYSQVSWYQQFPGKAPKLLIYEVSKRPSGVPDRFCGSKSGTSASLAISGLRSEDEADYYCQSYDSSLNSYIFGGGTKVTVL

SEQ ID NO: 17432 - protein, 252 aa, Artificial Sequence
  Description of Artificial Sequence: Synthetic polypeptide
MAEVQLLESGGGLVQPGGSLRLSCAASGFTFSNFVMNWVRQAPGKGLEWVSRINTDGTSTNYADSVTGRFTISRDNSKNTLYLQMNSLRAEDTAVYYCARSPYTIFGVVHFDYWGQGTLVTVSSGSAGGGGSGGGGSGGGGSDIVLTQPPSASGTPGQRVTISCSGSSSNIDSSPVNWYQQLPGAAPKLLIYLINERPSGVPDRFSGSKSGTSASLAISGLRSEDEADYYCQVWDSISDHWVFGGGTKLTVL

SEQ ID NO: 17433 - protein, 513 aa, Artificial Sequence; identical to SEQ ID NO: 17362
  Description of Artificial Sequence: Synthetic polypeptide

SEQ ID NO: 17434 - protein, 513 aa, Artificial Sequence; identical to SEQ ID NO: 17371
  Description of Artificial Sequence: Synthetic polypeptide

SEQ ID NO: 17435 - protein, 513 aa, Artificial Sequence; identical to SEQ ID NO: 17374
  Description of Artificial Sequence: Synthetic polypeptide

SEQ ID NO: 17436 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17437 - protein, 513 aa, Artificial Sequence; identical to SEQ ID NO: 17436
  Description of Artificial Sequence: Synthetic polypeptide

SEQ ID NO: 17438 - protein, 513 aa, Artificial Sequence; identical to SEQ ID NO: 17436
  Description of Artificial Sequence: Synthetic polypeptide

SEQ ID NO: 17439 - protein, 513 aa, Artificial Sequence; identical to SEQ ID NO: 17436
  Description of Artificial Sequence: Synthetic polypeptide

SEQ ID NO: 17440 - protein, 513 aa, Artificial Sequence
  Description of Artificial Sequence: Synthetic polypeptide
EFATMAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17441 - protein, 513 aa, Artificial Sequence; identical to SEQ ID NO: 17440
  Description of Artificial Sequence: Synthetic polypeptide

SEQ ID NO: 17442 - protein, 513 aa, Artificial Sequence; identical to SEQ ID NO: 17362
  Description of Artificial Sequence: Synthetic polypeptide

SEQ ID NO: 17443 - protein, 513 aa, Artificial Sequence; identical to SEQ ID NO: 17362
  Description of Artificial Sequence: Synthetic polypeptide

SEQ ID NO: 17444 - protein, 513 aa, Artificial Sequence; identical to SEQ ID NO: 15187
  Description of Artificial Sequence: Synthetic polypeptide

SEQ ID NO: 17445 - protein, 513 aa, Artificial Sequence; identical to SEQ ID NO: 17374
  Description of Artificial Sequence: Synthetic polypeptide

SEQ ID NO: 17446 - protein, 511 aa, Artificial Sequence
  Description of Artificial Sequence: Synthetic polypeptide
EFATMAVMAPRTLVLLLSGALALTQTWAGEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17447 - protein, 511 aa, Artificial Sequence
  Description of Artificial Sequence: Synthetic polypeptide
EFATMAVMAPRTLVLLLSGALALTQTWAGEVQLVESGGGLVKPGGSLKLSCAASGYTFTSYVMHWVRQAPGKCLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGCGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17448 - protein, 511 aa, Artificial Sequence
  Description of Artificial Sequence: Synthetic polypeptide
EFATMAVMAPRTLVLLLSGALALTQTWAGDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17449 - protein, 511 aa, Artificial Sequence
  Description of Artificial Sequence: Synthetic polypeptide
EFATMAVMAPRTLVLLLSGALALTQTWAGDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGCGTKLEIKGGGGSGGGGSGGGGSEVQLVESGGGLVKPGGSLKLSCAASGYTFTSYVMHWVRQAPGKCLEWIGYINPYNDGTKYNEKFQGRVTISSDKSISTAYMELSSLRSEDTAMYYCARGTYYYGTRVFDYWGQGTLVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17450 - protein, 506 aa, Artificial Sequence
  Description of Artificial Sequence: Synthetic polypeptide
EFATMAVMAPRTLVLLLSGALALTQTWAGEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSGGGGSGGGGSGGGGSAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17451 - protein, 506 aa, Artificial Sequence
  Description of Artificial Sequence: Synthetic polypeptide
EFATMAVMAPRTLVLLLSGALALTQTWAGEVQLVQSGAEVKKPGESLKISCKGSGYSFSSSWIGWVRQMPGKCLEWMGIIYPDDSDTRYSPSFQGQVTISADKSIRTAYLQWSSLKASDTAMYYCARHVTMIWGVIIDFWGQGTLVTVSSGGGGSGGGGSGGGGSAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGCGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17452 - protein, 506 aa, Artificial Sequence
  Description of Artificial Sequence: Synthetic polypeptide
EFATMAVMAPRTLVLLLSGALALTQTWAGAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17453 - protein, 506 aa, Artificial Sequence
  Description of Artificial Sequence: Synthetic polypeptide
EFATMAVMAPRTLVLLLSGALALTQTWAGAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGCGTKLEIKGGGGSGGGGSGGGGSEVQLVQSGAEVKKPGESLKISCKGSGYSFSSSWIGWVRQMPGKCLEWMGIIYPDDSDTRYSPSFQGQVTISADKSIRTAYLQWSSLKASDTAMYYCARHVTMIWGVIIDFWGQGTLVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17454 - protein, 503 aa, Artificial Sequence
  Description of Artificial Sequence: Synthetic polypeptide
EFATMAVMAPRTLVLLLSGALALTQTWAGQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17455 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17456 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQCLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGCGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17457 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQCLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGCGTKLELKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17458 - protein, 512 aa, Artificial Sequence
  Description of Artificial Sequence: Synthetic polypeptide
EFATMAVMAPRTLVLLLSGALALTQTWAGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17459 - protein, 512 aa, Artificial Sequence
  Description of Artificial Sequence: Synthetic polypeptide
EFATMAVMAPRTLVLLLSGALALTQTWAGEVQLVESGGGLVQPGGSLKLSCAASGFTFNKYAMNWVRQAPGKCLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGCGTKLTVLAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17460 - protein, 512 aa, Artificial Sequence; identical to SEQ ID NO: 17458
  Description of Artificial Sequence: Synthetic polypeptide

SEQ ID NO: 17461 - protein, 512 aa, Artificial Sequence; identical to SEQ ID NO: 17459
  Description of Artificial Sequence: Synthetic polypeptide

SEQ ID NO: 17462 - protein, 512 aa, Artificial Sequence; identical to SEQ ID NO: 17458
  Description of Artificial Sequence: Synthetic polypeptide

SEQ ID NO: 17463 - protein, 512 aa, Artificial Sequence; identical to SEQ ID NO: 17459
  Description of Artificial Sequence: Synthetic polypeptide

SEQ ID NO: 17464 - protein, 512 aa, Artificial Sequence; identical to SEQ ID NO: 17458
  Description of Artificial Sequence: Synthetic polypeptide

SEQ ID NO: 17465 - protein, 512 aa, Artificial Sequence; identical to SEQ ID NO: 17459
  Description of Artificial Sequence: Synthetic polypeptide

SEQ ID NO: 17466 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17467 - protein, 504 aa, Artificial Sequence; identical to SEQ ID NO: 10328
  Description of Artificial Sequence: Synthetic polypeptide
  Blinatumumab single chain variable fragment fusion protein (bite)

SEQ ID NO: 17468 - protein, 255 aa, Homo sapiens
QVQLVESGGTLVQPGGSLRLSCAASGFTFSSYAMSWIRQAPGKGLEWVSGISASGGYIDYADSVKGRVTISRDNSKNMAYLQMSSLRAEDTALYYCAKGGNYQMLLDHWGQGTLVTVSSASTKGPKLEEGEFSEARVDIQMTQSPSSLSASTGDRVTITCRASQDISSYLAWYQQAPGKAPHLLMSGATTLQTGVPSRFSGSGSGTDFTLTITSLQSEDFATYYCQQYYIYPPTFGQGTRVEIKRTVAAPSVFAA

SEQ ID NO: 17469 - protein, 260 aa, Artificial Sequence
  Description of Artificial Sequence: Synthetic polypeptide
  Humanised Antibody
QVQLVQSGAELKKPGSSMKVSCKASGDTFSTYSINWVRQAPGQGLEWMGVINPSGGSTSYAQKFQGRVTMTRDTSTSTVYMELSSLRSEDTAVYYCARRRIAYGYDEGHAMDYWGQGTLVTVSSASTKGPKLEEGEFSEARVDIQMTQSPSSLSASTGDRVTITCRASQDISSYLAWYQQAPGKAPHLLMSGATTLQTGVPSRFSGSGSGTDFTLTISSLQAEDVAVYYCQQYYRTPFTFGQGTKLEIKRTVAAPSVFAA

SEQ ID NO: 17470 - protein, 260 aa, Artificial Sequence
  Description of Artificial Sequence: Synthetic polypeptide
  Humanised Antibody
QVQLQQSGAEVKKPGSSVKVSCKASGGTFSTHTINWVRQAPGQGLEWMGGIAPMFGTANYAQKFQGRVTITADKSTSTAYMEMSSLRSDDTAVYYCARRRIAYGYDEGHAMDYWGQGTLVTVSSASTKGPKLEEGEFSEARVDIQMTQSPSSLSASTGDRVTITCRASQDISSYLAWYQQAPGKAPHLLMSGATTLQTGVPSRFSGSGSGTDFTLTISSLQAEDVAVYYCQQYYRTPFTFGQGTKLEIKRTVAAPSVFAA

SEQ ID NO: 17471 - protein, 253 aa, Homo sapiens
QVQLVQSGAEVKKDGASVKVSCKATGGTFSGHAISWVRQAPGQRLEWMGEISPMFGTPNYAQSFQGRVTITADESTSYMEVSSLRSEDTATYYCARGANYRALLDYWGQGTLVTVSSASTKGPKLEEGEFSEARVDIQMTQSPSSLSASTGDRVTITCRASQDISSYLAWYQQAPGKAPHLLMSGATTLQTGVPSRFSGSGSGTDFTLTITSLQSEDFATYYCQQYYIYPPTFGQGTRVEIKRTVAAPSVFAA

SEQ ID NO: 17472 - protein, 262 aa, Homo sapiens
QVQLVESGGGLVQPGGSLRLSCAASGFTFSNYWMSWVRQAPGKGLEWVANIKQDGSEKYYVDSVKGRFTISRDNAKNSLYLQMNSLRAEDTAVYYCARGSLCTDGSCPTIGPGPNWGQGTLVTVSSAPTKAPKLEEGEFSEARVDIQMTQSPSSLSASTGDRVTITCRASQDISSYLAWYQQAPGKAPHLLMSGATTLQTGVPSRFSGSGSGTDFTLTITSLQSEDFATYYCQQYYIYPPTFGQGTRVEIKRTVAAPSVFAA

SEQ ID NO: 17473 - protein, 1114 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGSGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 17474 - protein, 1124 aa, Artificial Sequence [sequence omitted]

SEQ ID NO: 17475 - protein, 118 aa, Mus musculus
VTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSS

SEQ ID NO: 17476 - protein, 498 aa, Artificial Sequence
  Description of Artificial Sequence: Synthetic polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGGGGSGGGGSGGGGSHVKLQESGPGLVQPSQSLSLTCTVSGFSLTDYGVHWVRQSPGKGLEWLGVIWSGGGTAYNTALISRLNIYRDNSKNQVFLEMNSLQAEDTAMYYCARRGSYPYNYFDAWGCGTTVTVSSGGGGSGGGGSGGGGSQAVVIQESALTTPPGETVTLTCGSSTGAVTASNYANWVQEKPDHCFTGLIGGHNNRPPGVPARFSGSLIGDKAALTIAGTQTEDEAIYFCALWYSDHWVIGGGTRLTVLG

SEQ ID NO: 17477 - protein, 501 aa, Artificial Sequence
  Description of Artificial Sequence: Synthetic polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPGGGGSGGGGSGGGGSQVQLVQSGGGVVQPGRSLRLSCKASGYTFTRYTMHWVRQAPGKGLEWIGYINPSRGYTNYNQKFKDRFTISRDNSKNTAFLQMDSLRPEDTGVYFCARYYDDHYCLDYWGQGTPVTVSSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 17478 - protein, 495 aa, Artificial Sequence
  Description of Artificial Sequence: Synthetic polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGGGGSGGGGSGGGGSQVQLVQSGGGVVQPGRSLRLSCKASGYTFTRYTMHWVRQAPGKGLEWIGYINPSRGYTNYNQKFKDRFTISRDNSKNTAFLQMDSLRPEDTGVYFCARYYDDHYCLDYWGQGTPVTVSSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 17479 - protein, 239 aa, Artificial Sequence
  Description of Artificial Sequence: Synthetic polypeptide
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 17480 - protein, 239 aa, Artificial Sequence
  Description of Artificial Sequence: Synthetic polypeptide
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 17481 - protein, 239 aa, Artificial Sequence
  Description of Artificial Sequence: Synthetic polypeptide
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 17482 - protein, 239 aa, Artificial Sequence
  Description of Artificial Sequence: Synthetic polypeptide
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 17483 - protein, 239 aa, Artificial Sequence
  Description of Artificial Sequence: Synthetic polypeptide
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 17484 - protein, 239 aa, Artificial Sequence
  Description of Artificial Sequence: Synthetic polypeptide
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 17485 - protein, 239 aa, Artificial Sequence
  Description of Artificial Sequence: Synthetic polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 17486 - protein, 239 aa, Artificial Sequence
  Description of Artificial Sequence: Synthetic polypeptide
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 17487 - protein, 239 aa, Artificial Sequence
  Description of Artificial Sequence: Synthetic polypeptide
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 17488 - protein, 239 aa, Artificial Sequence
  Description of Artificial Sequence: Synthetic polypeptide
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 17489 - protein, 239 aa, Artificial Sequence
  Description of Artificial Sequence: Synthetic polypeptide
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 17490 - protein, 239 aa, Artificial Sequence
  Description of Artificial Sequence: Synthetic polypeptide
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 17491 - protein, 239 aa, Artificial Sequence
  Description of Artificial Sequence: Synthetic polypeptide
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 17492 - protein, 239 aa, Artificial Sequence
  Description of Artificial Sequence: Synthetic polypeptide
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 17493 - protein, 239 aa, Artificial Sequence
  Description of Artificial Sequence: Synthetic polypeptide
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 17494 - protein, 266 aa, Artificial Sequence
  Description of Artificial Sequence: Synthetic polypeptide
  528scFv
QVQLVQSGAEVKKPGASVKVSCKASGYTFTSYWMHWVRQAPGQGLEWMGNIYPGSGGTNYAEKFKNRVTMTRDTSISTAYMELSRLRSDDTAVYYCARSGGPYFFDYWGQGTLVTVSSAGGGGSDIVMTQSPLSLPVTPGEPASISCRSSQNIVHNNGITYLEWYLQKPGQSPQLLIYKVSDRFSGVPDRFSGSGSGTDFTLKISRVEAEDVGVYYCFQGSHIPPTFGQGTKVEIKRAAAAEQKLISEEDLNLGGGMRGSHHHHHH

SEQ ID NO: 17495 - protein, 249 aa, Artificial Sequence
  Description of Artificial Sequence: Synthetic polypeptide
  single chain variable region fragment F2A2
EVQLVESGGGLVRPGGSLKLSCAASGFTFSDYYMYWVRQTPEKRLEWVASISGGDDYTYYSESVKGRFTISRDNAKNTLCLQMNSLKSDDTAMYYCVRGEGRNWDDYAMDYWGQGTSVTVSSGGGGSGGGGSGGGGSDIVMTQTPLSLPVSLGDQASISCRSSQSLVHTHGHTYLHWHLQKPGQSPKLLIYKVSNRFSGVPDRFSGSGSGTDFTLKISRVEAEDLGVYFCSQSTHVPRTFGGGTKLEIK

SEQ ID NO: 17496 - protein, 255 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTGGGGSGGGGSGGGGSGGGGSDIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRT

SEQ ID NO: 17497 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSVGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDSPGNQWVFGGGTKVTVLG

SEQ ID NO: 17498 - protein, 254 aa, Artificial Sequence
  Description of Artificial Sequence: Synthetic polypeptide
QVQLVQSGGGLVQPGGSLRLSCAASGFTFDDYAMHWVRQAPGKGLEWVAGISWNSGSIGYADSVKGRFTISRDNAKNSLYLQMNSLRPEDTAVYYCARDLGYNQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLG

SEQ ID NO: 17499 - protein, 253 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTGGGGSGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLG

SEQ ID NO: 17500 - protein, 254 aa, Artificial Sequence
  Description of Artificial Sequence: Synthetic polypeptide
QVQLVQSGGGLVQPGGSLRLSCAASGFTFDDYAMHWVRQAPGKGLEWVAGISWDSGSTGYADSVKGRFTISRDNAKNSLYLQMNSLRAEDTALYYCARDLGAYQWVEGFDYWGQGTLVTVSSASTGGGGSGGGGSGGGGSGGGGSSYELTQDPAVSVALGQTVRITCQGDSLRSYYASWYQQKPGQAPVLVIYGKNNRPSGIPDRFSGSTSGNSASLTITGAQAEDEADYYCNSRDSPGNQWVFGGGTKVTVLG

SEQ ID NO: 17501 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGFNQWVDGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDTPGDQWVFGGGTKVTVLG

SEQ ID NO: 17502 - protein, 252 aa, Artificial Sequence
  Description of Artificial Sequence: Synthetic polypeptide
EVQLLESGGGLVQPGGSLRLSCAASGFTFSAYGMGWVRQAPGKGLEWVSYISPSGGHTKYADSVKGRFTISRDNSKNTLYLQMNSLRAEDTAVYYCAKVLETGLLVDAFDIWGQGTMVTVSSASTGGGGSGGGGSGGGGSGGGGSQYELTQPPSVSVYPGQTASITCSGDQLGSKFVSWYQQRPGQSPVLVMYKDKRRPSEIPERFSGSNSGNTATLTISGTQAIDEADYYCQAWDSSTYVFGTGTKVTVLG

SEQ ID NO: 17503 - protein, 250 aa, Artificial Sequence
  Description of Artificial Sequence: Synthetic polypeptide
EVQLLESGGGLVQPGGSLRLSCAASGFTFSWYGMGWVRQAPGKGLEWVSYISPSGGITVYADSVKGRFTISRDNSKNTLYLQMNSLRAEDTAVYYCARLNYYYGLDVWGQGTTVTVSSASTGGGGSGGGGSGGGGSGGGGSDIQMTQSPSSLSASVGDRITITCQASQDIGDSLNWYQQKPGKAPRLLIYDASNLETGVPPRFSGSGSGTDFTFTFRSLQPEDIATYFCQQSANAPFTFGPGTKVDIKRT

SEQ ID NO: 17504 - protein, 252 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSSASTGGGGSGGGGSGGGGSGGGGSQSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVLG

SEQ ID NO: 17505 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWDSGSTGYADSVKGRFTISRDNAKNSLYLQMNSLRAEDTALYYCARDLGAYQWVEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCESRDSPGNQWVFGGGTKVTVLG

SEQ ID NO: 17506 - protein, 249 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 17507 - protein, 254 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCARDLGYNQWLEGFDYWGQGTLVTVSSASTGGGGSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCMSRDHPGNQWVFGGGTKVTVLG

SEQ ID NO: 17508 - protein, 253 aa, Artificial Sequence
  Description of Artificial Sequence: Synthetic polypeptide
EVQLLESGGGLVQPGGSLRLSCAASGFTFSRYGMWWVRQAPGKGLEWVSYIGSSGGPTYYVDSVKGRFTISRDNSKNTLYLQMNSLRAEDTAVYYCAGGRGTPYYFDSWGQGTLVTVSSASTGGGGSGGGGSGGGGSGGGGSQYELTQPASVSGSPGQSITISCTGTSSDIGRWNIVSWYQQHPGKAPKLMIYDVSNRPSGVSNRFSGSKSGNTASLTISGLQAEDEADYYCSSYTSSSTWVFGGGTKLTVLG

SEQ ID NO: 17509 - protein, 248 aa, Artificial Sequence; identical to SEQ ID NO: 14677
  Description of Artificial Sequence: Synthetic polypeptide

SEQ ID NO: 17510 - protein, 252 aa, Artificial Sequence
  Description of Artificial Sequence: Synthetic polypeptide
EVQLLESGGGLVQPGGSLRLSCAASGFTFSIYRMQWVRQAPGKGLEWVSGISPSGGTTWYADSVKGRFTISRDNSKNTLYLQMNSLRAEDTAVYYCARWSGGSGYAFDIWGQGTMVTVSSASTGGGGSGGGGSGGGGSGGGGSDIQMTQSPLSLSASVGDRVTITCQASRDIRNYLNWYQQKPGKAPKLLIYDASSLQTGVPSRFGGSGSGTDFSFTIGSLQPEDIATYYCQQFDSLPHTFGQGTKLEIKRT

SEQ ID NO: 17511 - protein, 261 aa, Artificial Sequence
  Description of Artificial Sequence: Synthetic polypeptide
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSSASTGGGGSGGGGSGGGGSGGGGSDIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIKRT

SEQ ID NO: 17512 - protein, 262 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTGGGGSGGGGSGGGGSGGGGSSSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG

SEQ ID NO: 17513 - protein, 257 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTGGGGSGGGGSGGGGSGGGGSDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRT

SEQ ID NO: 17514 - protein, 256 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTGGGGSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPLTFGQGTKVEIKRT

SEQ ID NO: 17515 - protein, 254 aa, Artificial Sequence
  Description of Artificial Sequence: Synthetic polypeptide
EVQLLQSGGGLVQPGGSLRLSCAASGFFFSKYPMHWVRQAPGKGLEWVSSISSDGGATVYADSVKGRFTISRDNSKNTLYLQMNSLRAEDTAVYYCAKDFYTWLTGNAFDSWGQGTSVTVSSASTGGGGSGGGGSGGGGSGGGGSDIQLTQSPSSLSASLGDRVTITCRASQGISSYLAWYQQKPGKAPKLLIYARSTRQSGVPSRFSGSGSGTEFTLTISSLQPEDSATYYCQQYWTWPLTFGGGTKVEIKRT

SEQ ID NO: 17516 - protein, 254 aa, Artificial Sequence
  Description of Artificial Sequence: Synthetic polypeptide
EVQLLQSGGGLVQPGGSLRLSCAASGFLFSSYPMHWVRQAPGKGLEWVGSISPSGGATPYADSVKGRFTISRDNSKNTLYLQMNSLRPEDTAVYYCAKDFYNILTGNAFDKWGQGTSVTVSSASTGGGGSGGGGSGGGGSGGGGSDIQLTQSPSSLSASLGDRVTITCRASQGISSYLAWYQQKPGKAPKLLIYAGSTPQSGVPSRFSGSGSGTEFTLTISSLQPEDSGTYYCQQYWTWPLTFGGGTKVEIKRT

SEQ ID NO: 17517 - protein, 254 aa, Artificial Sequence
  Description of Artificial Sequence: Synthetic polypeptide
EVQLLQSGGGLVQPGGSLRLSCAASGFDFSSYPMHWVRQAPGKGLEWVGSISSSGGATPYADSVKGRFTISRDNSKNTLYLQMNSLRPEDTAVYYCAKDFYTILTGNAFDMWGQGTSVTVSSASTGGGGSGGGGSGGGGSGGGGSDIQMTQSPSSLSASLGDRVTITCRASQGISSYLAWYQQKPGKAPKLLIYASSTRQSGVPSRFSGSGSGTDFTLTISSLQPEDSGTYYCQQYWAFPLTFGGGTKVEIKRT

SEQ ID NO: 17518 - protein, 254 aa, Artificial Sequence
  Description of Artificial Sequence: Synthetic polypeptide
EVQLLQSGGGLVQPGGSLRLSCAASGFMFSRYPMHWVRQAPGKGLEWVGSISGSGGATPYADSVKGRFTISRDNSKNTLYLQMNSLRAEDTAVYYCAKDFYQILTGNAFDYWGQGTTVTVSSASTGGGGSGGGGSGGGGSGGGGSDIQMTQSPSSLSASLGDRVTITCRASQGISSYLAWYQQKPGKAPKLLIYAKSTLQSGVPSRFSGSGSGTDFTLTISSLQPEDSATYYCQQYWTFPLTFGGGTKVEIKRT

SEQ ID NO: 17519 - protein, 248 aa, Mus musculus
QVQLQQSGAELASPGASVKLSCKASGYTFTTYWLQWVKQRPGQGLEWIGAIYPGPGNTKYTQKFKDKATLTADKSASTAYMQLNSLTSEDSAVYYCARRGSRRGIAYWGQGTLVTVSAASSGGGGSGGGGSGGGGSSNIVLTQSPASLAVSLGQRATISCRASESVDSYGRSFMHWYQQRPGQPPTLLIYLASNLESGVPVRFSGSGSRTDFTLTIDPVEADDAATYYCQQDNEDPYTFGGGTKLEIK

SEQ ID NO: 17520 - protein, 477 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGAAAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17521 - protein, 108 aa, Artificial Sequence
  Description of Artificial Sequence: Synthetic polypeptide
  Synthetic Antibody Domain
DIQMTQSPSSLSASVGDRVTITCRASQPIGSFLWWYQQKPGKAPKLLIYYSSYLQSGVPSRFSGSGSGTDFTLTISSLQPEDFATYYCQQYRWHPNTFGQGTKVEIKR

SEQ ID NO: 17522 - protein, 108 aa, Artificial Sequence
  Description of Artificial Sequence: Synthetic polypeptide
  Synthetic Antibody Domain
DIQMTQSPSSLSASVGDRVTITCRASQSIYSWLNWYQQKPGKAPKLLIYRASHLQSGVPSRFSGSGSGTDFTLTISSLQPEDFATYYCQQIWNMPFTFGQGTKVEIKR

SEQ ID NO: 17523 - protein, 108 aa, Artificial Sequence
  Description of Artificial Sequence: Synthetic polypeptide
  Synthetic Antibody Domain
DIQMTQSPSSLSASVGDRVTITCRASQPIGYDLFWYQQKPGKAPKLLIYRGSVLQSGVPSRFSGSGSGTDFTLTISSLQPEDFATYYCQQRWRWPFTFGQGTKVEIKR

SEQ ID NO: 17524 - protein, 108 aa, Artificial Sequence
  Description of Artificial Sequence: Synthetic polypeptide
  Synthetic Antibody Domain
DIQMTQSPSSLSASVGDRVTITCRASLPIGRDLWWYQQKPGKAPKLLIYRGSFLQSGVPSRFSGSGSGTDFTLTISSLQPEDFATYYCQQRWYYPHTFGQGTKVEIKR

SEQ ID NO: 17525 - protein, 108 aa, Artificial Sequence
  Description of Artificial Sequence: Synthetic polypeptide
  Synthetic Antibody Domain
DIQMTQSPSSLSASVGDRVTITCRASQDIEEWLMWYQQKPGKAPKLLIYNSSTLQSGVPSRFSGSGSGTDFTLTISSLQPEDYATYYCQQPLSRPFTFGQGTKVEIKR

SEQ ID NO: 17526 - protein, 108 aa, Artificial Sequence
  Description of Artificial Sequence: Synthetic polypeptide
  Synthetic Antibody Domain
DIQMTQSPSSLSASVGDRVTITCRASQHIDDWLFWYQQKPGKAPKLLIYRASFLQSGVPSRFSGSGSGTDFTLTISSLQPEDFATYYCQQPLSRPFTFGQGTKVEIKR

SEQ ID NO: 17527 - protein, 108 aa, Artificial Sequence
  Description of Artificial Sequence: Synthetic polypeptide
  Synthetic Antibody Domain
DIQMTQSPSSLSASVGDRVTITCRASQFIEDWLFWYQQKPGKAPKLLIYQASKLQSGVPSRFSGSGSGTDFTLTISSLQPEDFATYYCQQPLSRPFTFGQGTKVEIKR

SEQ ID NO: 17528 - protein, 108 aa, Artificial Sequence
  Description of Artificial Sequence: Synthetic polypeptide
  Synthetic Antibody Domain
DIQMTQSPSSLSASVGDRVTITCRASQPIDSWLMWYQQKPGKAPKLLIYQASRLQSGVPSRFSGSGSGTDFTLTISSLQPEDFATYYCQQPLSRPFTFGQGTKVEIKR

SEQ ID NO: 17529 - protein, 108 aa, Artificial Sequence
  Description of Artificial Sequence: Synthetic polypeptide
  Synthetic Antibody Domain
DIQMTQSPSSLSASVGDRVTITCRASQHIDDWLFWYQQKPGKAPKLLIYRASFLQSGVPPRFSGSGSGTDFTLTISSLQPEDFATYYCQQPLSRPFTFGQGTKVEIKR

SEQ ID NO: 17530 - protein, 108 aa, Artificial Sequence
  Description of Artificial Sequence: Synthetic polypeptide
  Synthetic Antibody Domain
DIQMTQSPSSLSASVGDRVTITCRASQNIDDHLMWYQQKPGKAPKLLIYSSSILQSGVPPRFSGSGSGTDFTLTISSLQPEDFATYYCQQPLSRPFTFGQGTKVEIKR

SEQ ID NO: 17531 - protein, 108 aa, Artificial Sequence
  Description of Artificial Sequence: Synthetic polypeptide
  Synthetic Antibody Domain
DIQMTQSPSSLSASVGDRVTITCRASQDIDHALLWYQQKPGKAPRLLIYNGSMLQSGVPSRFSGSGSGTDFTLTISSLQPEDFATYYCQQVLRRPFTFGQGTKVEIKR

SEQ ID NO: 17532 - protein, 108 aa, Artificial Sequence
  Description of Artificial Sequence: Synthetic polypeptide
  Synthetic Antibody Domain
DIQMTQSPSSLSASVGDRVTITCRASQHIGDWLLWYQQKPGKAPMLLIYQSSRLQSGVPSRFSGSGSGTDFILTISSLQPEDFATYYCQQPLSRPFTFGQGTKVEIKR

SEQ ID NO: 17533 - protein, 108 aa, Artificial Sequence
  Description of Artificial Sequence: Synthetic polypeptide
  Synthetic Antibody Domain
DIQMTQSPSSLSASVGDRVTITCRASQHIDSYLMWYQQKPGKAPKLLIYNTSVLQSGVPSRFSGSGSGTDFTLTISSLQPEDFATYYCQQPLSRPFTFGQGTKVEIKR

SEQ ID NO: 17534 - protein, 108 aa, Artificial Sequence
  Description of Artificial Sequence: Synthetic polypeptide
  Synthetic Antibody Domain
DIQMTQSPSSLSASVGDRVTITCRASQWIDDHLFWYQQKPGKAPKLLIYNTSTLQSGVPSRFSGSGSGTDFILTISSLQPEDFATYYCQQPLSRPFTFGQGTKVEIKR

SEQ ID NO: 17535 - protein, 108 aa, Artificial Sequence
  Description of Artificial Sequence: Synthetic polypeptide
  Synthetic Antibody Domain
DIQMTQSPSSLSASVGDRVTITCRASQFIDEHLMWYQQKPGKAPKLLIYRSSELQSGVPSRFSGSGSGTDFTLTISSLQPEDFATYYCQQPLSRPFTFGQGTKVEIKR

SEQ ID NO: 17536 - protein, 108 aa, Artificial Sequence
  Description of Artificial Sequence: Synthetic polypeptide
  Synthetic Antibody Domain
DIQMTQSPSSLSASVGDRVTITCRASQWINNWLLWYQQKPGKAPKLLIYESSNLQSGVPSRFSGSGSGTDFTLTISSLQPEDFATYYCQQPLSRPFTFGQGTKVEIKR

SEQ ID NO: 17537 - protein, 107 aa, Artificial Sequence
  Description of Artificial Sequence: Synthetic polypeptide
  Synthetic Antibody Domain
DIQMTQSPSSLSASVGDRVTITCRASQLIDDHFWYQQKPGKAPTLLIYNSSVLQSGVPSRFSGSGSGTDFTLTISSLQPEDFATYYCQQPLSRPFTFGQGTKVEIKR

SEQ ID NO: 17538 - protein, 108 aa, Artificial Sequence
  Description of Artificial Sequence: Synthetic polypeptide
  Synthetic Antibody Domain
DIQMTQSPSSLSASVGDRVTITCRASQDIDQWLMWYQQKPGKAPKLLIYQSSMLQSGVPSRFSGSGSGTDFTLTISSLQPEDFATYYCQQPLSRPFTFGQGTKVEIKR

SEQ ID NO: 17539 - protein, 108 aa, Artificial Sequence
  Description of Artificial Sequence: Synthetic polypeptide
  Synthetic Antibody Domain
DIQMTQSPSSLSASVGDRVTITCQASQDIDNWLLWYQQKPGKAPKLLIYQASNLQSGVPSRFSGSGSGTDFTLTISSLQPEDFATYYCQQPLSRPFTFGQGTKVEIKR

SEQ ID NO: 17540 - protein, 108 aa, Artificial Sequence
  Description of Artificial Sequence: Synthetic polypeptide
  Synthetic Antibody Domain
DIQMTQSPSSLSASVGDRVTITCRASQPIDSWLMWYQQKPGKAPKLLIYQASRLQSGVPSRFSGSGSGTDFTLTISSLQPEDFATYYCQQPLSGPFTFGQGTKVEIKR

SEQ ID NO: 17541 - protein, 108 aa, Artificial Sequence
  Description of Artificial Sequence: Synthetic polypeptide
  Synthetic Antibody Domain
DIQMTQSPSSLSASVGDRVTITCRASQYIDYGLMWYQQKPGKAPKLLIYRTSELQSGVPSRFSGSGSGTDFTLTISSLQPEDFATYYCQQPLSRPFTFGQGTKVEIKR

SEQ ID NO: 17542 - protein, 108 aa, Artificial Sequence
  Description of Artificial Sequence: Synthetic polypeptide
  Synthetic Antibody Domain
DIQMTQSPSSLSASVGDRVTITCRASQWIDSFLMWYQQKPGKAPKLLIYNGSVLQSGVPSRFSGSGSGTDFTLTISSLQPEDFATYYCQQPLSRPFTFGQGTKVEIKR

SEQ ID NO: 17543 - protein, 108 aa, Artificial Sequence
  Description of Artificial Sequence: Synthetic polypeptide
  Synthetic Antibody Domain
DIQMTQSPSSLSASVGDRVTITCRASQDIGPWLMWYQQKPGKAPKLLIYQGSRLQSGVPLRFSGSGSGTDFTLTISSLQPEDFATYYCQQPLSRPFTFGQGTKVEIRR

SEQ ID NO: 17544 - protein, 108 aa, Artificial Sequence
  Description of Artificial Sequence: Synthetic polypeptide
  Synthetic Antibody Domain
DIQMTQSPSSLSASVGDRVTITCRASQHIDSWLLWYQQKPGKAPKLLIYNGSVLQSGVPSRFSGSGSGTDFTLTISSLQPEDFATYYCQQPLSGPFTFGQGTKVEIKR

SEQ ID NO: 17545 - protein, 108 aa, Artificial Sequence
  Description of Artificial Sequence: Synthetic polypeptide
  Synthetic Antibody Domain
DIQMTQSPSSLSASVGDRVTITCRASQHIDTHLFWYQQKPGKAPKLLIYNTSTLQSGVPSRFSGSGSGTDFTLTISSLQPEDFATYYCQQPLSRPFTFGQGTKVEIKR

SEQ ID NO: 17546 - protein, 108 aa, Artificial Sequence
  Description of Artificial Sequence: Synthetic polypeptide
  Synthetic Antibody Domain
DIQMTQSPSSLSASVGDRVTITCRASQFIDTHLMWYQQKPGKAPRLLIYNTSTLQSGVPSRFSGSGSGTDFTLTISSLQPEDFATYYCQQPLSRPFTFGQGTKVEIKR

SEQ ID NO: 17547 - protein, 108 aa, Artificial Sequence
  Description of Artificial Sequence: Synthetic polypeptide
  Synthetic Antibody Domain
DIQMTQSPSSLSASVGDRVTITCRASQDIDDWLLWYQQKPGKAPKLLIYQGSRLQSGVPSRFSGSGSGTDFTLTISSLQPEDFATYYCQQPLSRPFTFGQGTKVEIKR

SEQ ID NO: 17548 - protein, 108 aa, Artificial Sequence
  Description of Artificial Sequence: Synthetic polypeptide
  Synthetic Antibody Domain
DIQMTQSPSSLSASVGDRVTITCRASQWIDDTLMWYQQKPGKAPKLLIYRSSMLQSGVPSRFSGSGSGTDFTLTISSLQPEDFATYYCQQPLSRPFTFGQGTKVEIKR

SEQ ID NO: 17549 - protein, 108 aa, Artificial Sequence
  Description of Artificial Sequence: Synthetic polypeptide
  Synthetic Antibody Domain
DIQMTQSPSSLSASVGDRVTITCRASQYIDSHLMWYQQKPGKAPKLLIYDTSRLQSGVPSRFSGSGSGTDFTLTISSLQPEDFATYYCQQPLSRPFTFGQGTKVEIKR

SEQ ID NO: 17550 - protein, 108 aa, Artificial Sequence
  Description of Artificial Sequence: Synthetic polypeptide
  Synthetic Antibody Domain
DIQMTQSPSSLSASVGDRVTITCRASQHIDQHLFWYQQKPGKAPKLLIYNSSSLQSGVPSRFSGSGSGTDFTLTISSLQPEDFATYYCQQPLSRPFTFGQGTKVEIKR

SEQ ID NO: 17551 - protein, 108 aa, Artificial Sequence
  Description of Artificial Sequence: Synthetic polypeptide
  Synthetic Antibody Domain
DIQMTQSPSSLSASVGDRVTITCRASQHIERWLLWYQQKPGKAPKLLIYNSSKLQSGVPSRFSGSGSGTDFTLTISSLQPEDFATYYCQQPLSRPFTFGQGTKVEIKR

SEQ ID NO: 17552 - protein, 108 aa, Artificial Sequence
  Description of Artificial Sequence: Synthetic polypeptide
  Synthetic Antibody Domain
DIQMTQSPSSLSASVGDRVTISCRASQHIERWLLWYQQKPGKAPKLLIYNSSKLQSGVPSRFSGSGSGTDFTLTISSLQPEDFATYYCQQPLSRPFTFGQGTKVEIKR

SEQ ID NO: 17553 - protein, 108 aa, Artificial Sequence
  Description of Artificial Sequence: Synthetic polypeptide
  Synthetic Antibody Domain
DIQMTQSPSSLSASVGDRVTITCRASQDIGSWLMWYQQKSGKAPKLLIYNGSALQSGVPSRFSGSGSGTDFTLTISSLQPEDFATYYCQQPLSRPFTFGQGTKVEIKR

SEQ ID NO: 17554 - protein, 108 aa, Artificial Sequence
  Description of Artificial Sequence: Synthetic polypeptide
  Synthetic Antibody Domain
DIQMTQSPSSLSASVGDRVTITCRASQHIDKWLMWYQQKPGKAPKLLIYQASKLQSGVPSRFSGSGSGTDFTLTISSLQPEDFATYYCQQPLSRPFTFGQGTKVEIKR

SEQ ID NO: 17555 - protein, 108 aa, Artificial Sequence
  Description of Artificial Sequence: Synthetic polypeptide
  Synthetic Antibody Domain
DIQMTQSPSSLSASVGDRVTITCRASQDIEEWLMWYQQKPGKAPKLLIYNSSTLQSGVPSRFSGSGSGTDFTLTISSLQPEDFATYYCQQPLSRPFTFGQGTKVEIKR

SEQ ID NO: 17556 - protein, 100 aa, Artificial Sequence
  Description of Artificial Sequence: Synthetic polypeptide
  Synthetic Antibody Domain
DIQMTQSPSSLSASVGDRVTITCRASQYIDYGLMWYQQKPGKAPKLLIYRTSELQSGVPSRFSGSGSGTDFTLTISSLQPEDFATYYCQQPLSRPFTFGQ

SEQ ID NO: 17557 - protein, 108 aa, Artificial Sequence
  Description of Artificial Sequence: Synthetic polypeptide
  Synthetic Antibody Domain
DIQMTQSPSSLSASVGDRVTITCRASQNIDIHLMWYQQKPGKAPKLLIYQSSNLQSGVPSPFSGSGSGTDFTLTISSLQPEDFATYYCQQPLSRPFTFGQGTKVEIKR

SEQ ID NO: 17558 - protein, 108 aa, Artificial Sequence
  Description of Artificial Sequence: Synthetic polypeptide
  Synthetic Antibody Domain
DIQMTQSPSSLSASVGDRVTITCRASQDIGPWLLWYQQKPGKAPKLLIYQSSELQSGVPSRFSGSGSGTDFTLTISSLQPEDLATYYCQQPLSRPFTFGQGTKVEIKR

SEQ ID NO: 17559 - protein, 108 aa, Artificial Sequence
  Description of Artificial Sequence: Synthetic polypeptide
  Synthetic Antibody Domain
DIQMTQSPSSLSASVGDRVTITCRASQEIGVWLMWYQQKPGKAPKLLIYEGSRLQSGVPSRFSGSGSGTDFTLTISSLQPEDFATYYCQQPLSRPFVFGQGTKVEIKR

SEQ ID NO: 17560 - protein, 108 aa, Artificial Sequence
  Description of Artificial Sequence: Synthetic polypeptide
  Synthetic Antibody Domain
DIQMTQSPSSLSASVGDRVTITCRASQSIGKWLMWYQQKPGKAPKLLIYQSSLLQSGVPSRFSGSGSGTDFTLTISSLQPEDFATYYCQQPLSRPFTFGQGTKVEIKR

SEQ ID NO: 17561 - protein, 108 aa, Artificial Sequence
  Description of Artificial Sequence: Synthetic polypeptide
  Synthetic Antibody Domain
DIQMTQSPSSLSASVGDRVTITCRASQDIDTWLFWYQQKPGKAPKLLIYNGSRLQSGVPSRFSGSGSGTDFTLTISGLQPEDFATYYCQQPLSRPFTFGQGTKVEIKR

SEQ ID NO: 17562 - protein, 108 aa, Artificial Sequence
  Description of Artificial Sequence: Synthetic polypeptide
  Synthetic Antibody Domain
DIQMTQSPSSLSASVGDRVTITCRASQDIEGWLLWYQQKPGKAPKLLIYNSSTLQSGVPSRFSGSGSGTDFTLTISSLQPEDFATYYCQQPLSRPFTFGQGTKVEIKR

SEQ ID NO: 17563 - protein, 108 aa, Artificial Sequence
  Description of Artificial Sequence: Synthetic polypeptide
  Synthetic Antibody Domain
DIQMTQSPSSLSASVGDRVTITCRASQPIEEWLLWYQQKPGKAPKLLIYNGSHLQSGVPSRFSGSGSGTDFTLTISSLQPEDFATYYCQQPLSRPFTFGQGTKVEIKR

SEQ ID NO: 17564 - protein, 108 aa, Artificial Sequence
  Description of Artificial Sequence: Synthetic polypeptide
  Synthetic Antibody Domain
DIQMTQSPSSLSASVGDRVTITCRASQPIDYGLMWYQQKPGKAPKLLIYRSSQLQSGVPSRFSGSGSGTDFTLTISSLQPEDFATYYCQQPLSRPFTFGQGTKVEIKR

SEQ ID NO: 17565 - protein, 108 aa, Artificial Sequence
  Description of Artificial Sequence: Synthetic polypeptide
  Synthetic Antibody Domain
DIQMTQSPSSLSASVGDRVTITCRASQEIGSWLMWYQQKPGKAPKLLIYQSSKLQSGVPSRFSGSGSGTDFTLTISSLQPEDFATYYCQQPLSRPFTFGQGTKVEIKR

SEQ ID NO: 17566 - protein, 108 aa, Artificial Sequence
  Description of Artificial Sequence: Synthetic polypeptide
  Synthetic Antibody Domain
DIQMTQSPSSLSASVGDRVTITCRASQPIDSWLLWYQQKPGKAPKLLIYNASSLQSGVPSRESGSGSGTDFTLTISSLQPEDFATYYCQQPLSRPFTFGQGTKVEIKR

SEQ ID NO: 17567 - protein, 108 aa, Artificial Sequence
  Description of Artificial Sequence: Synthetic polypeptide
  Synthetic Antibody Domain
DIQMTQSPSSLSASVGDRVTITCRASQDIGPWLMWYQQKPGKAPKLLIYQASALQSGVPSRFSGSGSGTDFTLTISSLQPEDFATYYCQQPLSRPFTFGQGTKVEIKR

SEQ ID NO: 17568 - protein, 108 aa, Artificial Sequence
  Description of Artificial Sequence: Synthetic polypeptide
  Synthetic Antibody Domain
DIQMTQSPSSLSASVGDRVTITCRASQNIHEWLMWYQQKPGKAPKLLIYQGSRLQSGVPSRFSGSGSGTDFTLTISSLQPEDFATYYCQQPLSRPFTFGQGTKVEIKR

SEQ ID NO: 17569 - protein, 109 aa, Artificial Sequence
  Description of Artificial Sequence: Synthetic polypeptide
  Synthetic Antibody Domain
DIQMTQSPSSLSASVGDRVTITCRASQDIGPWLMWYQQKPGKAPKLLIYQASALQSGVPSRFSGSGSGTDFTLTISSLQPEDSATYYCQQPLSRLPFTFGQGTKVEIKR

SEQ ID NO: 17570 - protein, 108 aa, Artificial Sequence
  Description of Artificial Sequence: Synthetic polypeptide
  Synthetic Antibody Domain
DIQMTQSPSSLSASVGDRVTITCRASQSVKEFLWWYQQKPGKAPKLLIYMASNLQSGVPSRFSGSGSGTDFTLTISSLQPEDFATYYCQQKFKLPRTFGQGTKVEIKR

SEQ ID NO: 17571 - protein, 108 aa, Artificial Sequence; identical to SEQ ID NO: 15076
  Description of Artificial Sequence: Synthetic polypeptide
  Synthetic Antibody Domain

SEQ ID NO: 17572 - protein, 108 aa, Artificial Sequence; identical to SEQ ID NO: 15077
  Description of Artificial Sequence: Synthetic polypeptide
  Synthetic Antibody Domain

SEQ ID NO: 17573 - protein, 108 aa, Artificial Sequence; identical to SEQ ID NO: 15078
  Description of Artificial Sequence: Synthetic polypeptide
  Synthetic Antibody Domain

SEQ ID NO: 17574 - protein, 108 aa, Artificial Sequence; identical to SEQ ID NO: 15079
  Description of Artificial Sequence: Synthetic polypeptide
  Synthetic Antibody Domain

SEQ ID NO: 17575 - protein, 108 aa, Artificial Sequence; identical to SEQ ID NO: 15080
  Description of Artificial Sequence: Synthetic polypeptide
  Synthetic Antibody Domain

SEQ ID NO: 17576 - protein, 108 aa, Artificial Sequence; identical to SEQ ID NO: 15081
  Description of Artificial Sequence: Synthetic polypeptide
  Synthetic Antibody Domain

SEQ ID NO: 17577 - protein, 108 aa, Artificial Sequence; identical to SEQ ID NO: 15082
  Description of Artificial Sequence: Synthetic polypeptide
  Synthetic Antibody Domain

SEQ ID NO: 17578 - protein, 108 aa, Artificial Sequence; identical to SEQ ID NO: 15083
  Description of Artificial Sequence: Synthetic polypeptide
  Synthetic Antibody Domain

SEQ ID NO: 17579 - protein, 108 aa, Artificial Sequence; identical to SEQ ID NO: 15084
  Description of Artificial Sequence: Synthetic polypeptide
  Synthetic Antibody Domain

SEQ ID NO: 17580 - protein, 108 aa, Artificial Sequence; identical to SEQ ID NO: 15085
  Description of Artificial Sequence: Synthetic polypeptide
  Synthetic Antibody Domain

SEQ ID NO: 17581 - protein, 108 aa, Artificial Sequence; identical to SEQ ID NO: 15086
  Description of Artificial Sequence: Synthetic polypeptide
  Synthetic Antibody Domain

SEQ ID NO: 17582 - protein, 108 aa, Artificial Sequence; identical to SEQ ID NO: 15087
  Description of Artificial Sequence: Synthetic polypeptide
  Synthetic Antibody Domain

SEQ ID NO: 17583 - protein, 108 aa, Artificial Sequence; identical to SEQ ID NO: 15088
  Description of Artificial Sequence: Synthetic polypeptide
  Synthetic Antibody Domain

SEQ ID NO: 17584 - protein, 108 aa, Artificial Sequence; identical to SEQ ID NO: 15089
  Description of Artificial Sequence: Synthetic polypeptide
  Synthetic Antibody Domain

SEQ ID NO: 17585 - protein, 108 aa, Artificial Sequence; identical to SEQ ID NO: 15090
  Description of Artificial Sequence: Synthetic polypeptide
  Synthetic Antibody Domain

SEQ ID NO: 17586 - protein, 108 aa, Artificial Sequence; identical to SEQ ID NO: 15091
  Description of Artificial Sequence: Synthetic polypeptide
  Synthetic Antibody Domain

SEQ ID NO: 17587 - protein, 118 aa, Artificial Sequence; identical to SEQ ID NO: 15092
  Description of Artificial Sequence: Synthetic polypeptide
  Synthetic Antibody Domain

SEQ ID NO: 17588 - protein, 116 aa, Artificial Sequence; identical to SEQ ID NO: 15093
  Description of Artificial Sequence: Synthetic polypeptide
  Synthetic Antibody Domain

SEQ ID NO: 17589 - protein, 119 aa, Artificial Sequence; identical to SEQ ID NO: 15094
  Description of Artificial Sequence: Synthetic polypeptide
  Synthetic Antibody Domain

SEQ ID NO: 17590 - protein, 124 aa, Artificial Sequence; identical to SEQ ID NO: 15095
  Description of Artificial Sequence: Synthetic polypeptide
  Synthetic Antibody Domain

SEQ ID NO: 17591 - protein, 121 aa, Artificial Sequence; identical to SEQ ID NO: 15096
  Description of Artificial Sequence: Synthetic polypeptide
  Synthetic Antibody Domain

SEQ ID NO: 17592 - protein, 116 aa, Artificial Sequence; identical to SEQ ID NO: 15097
  Description of Artificial Sequence: Synthetic polypeptide
  Synthetic Antibody Domain

SEQ ID NO: 17593 - protein, 116 aa, Artificial Sequence; identical to SEQ ID NO: 15098
  Description of Artificial Sequence: Synthetic polypeptide
  Synthetic Antibody Domain

SEQ ID NO: 17594 - protein, 116 aa, Artificial Sequence; identical to SEQ ID NO: 15099
  Description of Artificial Sequence: Synthetic polypeptide
  Synthetic Antibody Domain

SEQ ID NO: 17595 - protein, 123 aa, Artificial Sequence; identical to SEQ ID NO: 15100
  Description of Artificial Sequence: Synthetic polypeptide
  Synthetic Antibody Domain

SEQ ID NO: 17596 - protein, 123 aa, Artificial Sequence; identical to SEQ ID NO: 15101
  Description of Artificial Sequence: Synthetic polypeptide
  Synthetic Antibody Domain

SEQ ID NO: 17597 - protein, 123 aa, Artificial Sequence; identical to SEQ ID NO: 15102
  Description of Artificial Sequence: Synthetic polypeptide
  Synthetic Antibody Domain

SEQ ID NO: 17598 - protein, 125 aa, Lama glama
  EG2
QVKLEESGGGLVQAGDSLRVSCAASGRDFSDYVMGWFRQAPGKEREFVAAISRNGLTTRYADSVKGRFTISRDNDKNMVYLQMNSLKPEDTAVYYCAVNSAGTYVSPRSREYDYWGQGTQVTVSS

SEQ ID NO: 17599 - protein, 109 aa, Lama glama
  EG5
SLRLSCVDSGRDFSDYVMGWFRQAPGKEREFVAAISRNGITTRYADSVKGRFTISRDNDKNTVYLQMNSLRPEDTAVYYCATNSAGTYVSPRSRDYDGWGQGTQVTVSS

SEQ ID NO: 17600 - protein, 125 aa, Lama glama
  EG28
QVQLVESGGGLVQAGDSLRLSCVDSGRDFSDYVMGWFRQAPGKEREFVAAISRNGITTRYADSVKGRFTISRDNDKNTVYLQMNSLKPEDTAVYYCATNSAGTYVSPRSRDYDGWGQGTQVTVSS

SEQ ID NO: 17601 - protein, 123 aa, Lama glama
  EG6
QVKLEESGGGLVQAGGSLTLSCAASGGTFSSYAMGWFRQAPGKEREFVAAISGRSSIRNYDDSVKGRFAISRDNAKNTVYLQMNSLKPEDTAVYYCAADTVFRSFVVGNVKEWGQGTQVTVSS

SEQ ID NO: 17602 - protein, 123 aa, Lama glama
  EG10
QVQLVESGGGLVQAGGSLTLSCAASGGTFSSYAMGWFRQAPGKEREFVAAISGRSSIRNYDDSVKGRFAISRDSAKNTVYLQMNSLKPEDTAVYYCAADTVFRSFVVGNVKEWGQGTQVTVSS

SEQ ID NO: 17603 - protein, 116 aa, Lama glama
  EG7
QVQLVESGGGLVQPGGSLRLSCAASESFFNFDAWGWYRQAPGKQREMVAVVGSTGSTSYADFVKGRFTISRDNANNTVYLQMNTLRPEDTAVYYCYARFQSLYNSWGQGTQVTVSS

SEQ ID NO: 17604 - protein, 116 aa, Lama glama
  EG16
AVQLVESGGGLVQPGGSLRLSCAASVSIFDIDAWGWYRQAPGKQREMVALVGSTGSTSYADSVKGRFTLSRDNVNNTMYLQMNSLRPEDTAVYYCYARFDSLYNSWGQGTQVTVSS

SEQ ID NO: 17605 - protein, 115 aa, Lama glama
  EG29
VKLEESGGGLVQPGGSLRLSCAASESFFNFDAWGWYRQAPGKQREMVAVVGSTGSTSYADFVKGRFTISRDNANNTVYLQMNTLRPEDTAVYYCYARFQSLYNSWGQGTQVTVSS

SEQ ID NO: 17606 - protein, 116 aa, Lama glama
  EG30
QVKLEESGGGLVQPGGSLRLSCAASVSIFDIDAWGWYRQAPGKQREMVALVGSTGSTSYADSVKGRFTLSRDNVNNTMYLQMNSLRPEDTAVYYCYARFDSLYNSWGQGTQVTVSS

SEQ ID NO: 17607 - protein, 116 aa, Lama glama
  EG43
QVQLVESGGGLVQPGGSLRLPCAASGSIFSLDAWGWYRQAPGKQREMVALVGSDGSTSYADSVKGRFTISRDNANNTFYLQMNSLKPEDTAVYYCYARFQSLYNSWGQGTQVTVSS

SEQ ID NO: 17608 - protein, 116 aa, Lama glama
  EG31
QVKLEESGGGLVQVGGSLRLSCAHSGLPFGINAIGWYRQGPGNQRDLVARITSDGRTILEDSVKGRFTISRDNAKKTVYVQMNNLKPEDTAVYYCAAEKGGSPLYWGQGTQVTVSS

SEQ ID NO: 17609 - protein, 506 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17610 - protein, 243 aa, Artificial Sequence
  Description of Artificial Sequence: Synthetic polypeptide
  Synthetic CD3 VH-VL
QVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQIT

SEQ ID NO: 17611 - protein, 532 aa, Artificial Sequence
  Description of Artificial Sequence: Synthetic polypeptide
EFATMAVMAPRTLVLLLSGALALTQTWAGSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGSGQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSSGGGGSSGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 17612 - protein, 617 aa, Artificial Sequence
  Description of Artificial Sequence: Synthetic polypeptide
EFATMAVMAPRTLVLLLSGALALTQTWAGQVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARA

SEQ ID NO: 17613 - protein, 527 aa, Artificial Sequence
  Description of Artificial Sequence: Synthetic polypeptide
EFATMAVMAPRTLVLLLSGALALTQTWAGSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGSGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 17614 - protein, 612 aa, Artificial Sequence
  Description of Artificial Sequence: Synthetic polypeptide
EFATMAVMAPRTLVLLLSGALALTQTWAGDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARA

SEQ ID NO: 17615 - protein, 448 aa, Artificial Sequence
  Description of Artificial Sequence: Synthetic polypeptide
QVQLVESGGGVVQPGRSLRLSCAASGFKFSGYGMHWVRQAPGKGLEWVAVIWYDGSKKYYVDSVKGRFTISRDNSKNTLYLQMNSLRAEDTAVYYCARQMGYWHFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17616 - protein, 452 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17617 - protein, 449 aa, Artificial Sequence
  Description of Artificial Sequence: Synthetic polypeptide
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17618 - protein, 451 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17619 - protein, 213 aa, Artificial Sequence; identical to SEQ ID NO: 8039
  Description of Artificial Sequence: Synthetic polypeptide

SEQ ID NO: 17620 - protein, 449 aa, Artificial Sequence; identical to SEQ ID NO: 17617
  Description of Artificial Sequence: Synthetic polypeptide

SEQ ID NO: 17621 - protein, 452 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17622 - protein, 213 aa, Artificial Sequence
  Description of Artificial Sequence: Synthetic polypeptide
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17623 - protein, 483 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17624 - protein, 452 aa, Artificial Sequence; identical to SEQ ID NO: 17616
  Description of Artificial Sequence: Synthetic polypeptide

SEQ ID NO: 17625 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17626 - protein, 483 aa, Artificial Sequence; identical to SEQ ID NO: 17623
  Description of Artificial Sequence: Synthetic polypeptide

SEQ ID NO: 17627 - protein, 451 aa, Artificial Sequence
  Description of Artificial Sequence: Synthetic polypeptide
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17628 - protein, 219 aa, Artificial Sequence
  Description of Artificial Sequence: Synthetic polypeptide
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17629 - protein, 449 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 17630 - protein, 482 aa, Artificial Sequence
  Description of Artificial Sequence: Synthetic polypeptide
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGGSGGGGSGGGGSDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17631 - protein, 213 aa, Artificial Sequence; identical to SEQ ID NO: 9480
  Description of Artificial Sequence: Synthetic polypeptide

SEQ ID NO: 17632 - protein, 483 aa, Artificial Sequence; identical to SEQ ID NO: 17623
  Description of Artificial Sequence: Synthetic polypeptide

SEQ ID NO: 17633 - protein, 478 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 17634 - protein, 449 aa, Artificial Sequence; identical to SEQ ID NO: 17629
  Description of Artificial Sequence: Synthetic polypeptide

SEQ ID NO: 17635 - protein, 478 aa, Artificial Sequence; identical to SEQ ID NO: 17633
  Description of Artificial Sequence: Synthetic polypeptide

SEQ ID NO: 17636 - protein, 455 aa, Artificial Sequence
  Description of Artificial Sequence: Synthetic polypeptide
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17637 - protein, 452 aa, Artificial Sequence
  Description of Artificial Sequence: Synthetic polypeptide
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17638 - protein, 97 aa, Artificial Sequence
  Description of Artificial Sequence: Synthetic polypeptide
NVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDT

SEQ ID NO: 17639 - protein, 440 aa, Artificial Sequence
  Description of Artificial Sequence: Synthetic polypeptide
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSASTKGPSVFPLAPCSKSTSGGTAALGCLVKDYFPEPVTVSWNSGALTSGVHTFPAVLQSSGLYSLSSVVTVPSSSLGTQTYICNVNHKPSNTKVDKRVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17640 - protein, 766 aa, Homo sapiens [sequence omitted]

SEQ ID NO: 17641 - protein, 588 aa, Artificial Sequence
  Description of Artificial Sequence: Synthetic polypeptide
  Synthetic construct
MGWSCIILFLVATATGVHSEVQLVESGGGLVQPGGSLRLSCAASGFTVSGSYMSWVRQAPGKGLEWVSVIYSGGSTYYADSVKGRFTISRDNSKNTLYLQMNSLRAEDTAVYYCARDLRGSYDYWGQGTLVIVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 17642 - protein, 238 aa, Artificial Sequence
  Description of Artificial Sequence: Synthetic polypeptide
  Synthetic construct
MGWSCIILFLVATATGVHSEIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17643 - protein, 218 aa, Homo sapiens
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 17644 - protein, 449 aa, Homo sapiens
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17645 - protein, 449 aa, Homo sapiens
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17646 - protein, 765 aa, Homo sapiens
METDTLLLWVLLLWVPGSTGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSLEGGGSIKQIEDKIEEILSKIYHIENEIARIKKLIGERGHDIERKCCVECPPCPRLEGPRFEEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17647 - protein, 764 aa, Homo sapiens [sequence omitted]

SEQ ID NO: 17648 - protein, 766 aa, Homo sapiens
METDTLLLWVLLLWVPGSTGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSLEGGGSIKQIEDKIEEILSKIYHIENEIARIKKLIGERGHDIERKCCVECPPCPRLEGPRFEEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17649 - protein, 766 aa, Homo sapiens [sequence omitted]

SEQ ID NO: 17650 - protein, 449 aa, Artificial Sequence; identical to SEQ ID NO: 15550
  Description of Artificial Sequence: Synthetic polypeptide

SEQ ID NO: 17651 - protein, 114 aa, Artificial Sequence
  Description of Artificial Sequence: Synthetic polypeptide
  Artificial antibody domain sequence
WSASTDIQMTQSPSSLSASVGDRVTITCRASQSIDSYLHWYQQKPGKAPKLLIYSASELQSGVPSRFSGSGSGTDFTLTISSLQPEDFATYYCQQVVWRPFTFGQGTKVEIKRC

SEQ ID NO: 17652 - protein, 483 aa, Mus musculus
MKVFRRKALVLCAGYALLLVLTMLNLLDYKWHKEPLQQCNPDGPLGAAVGAAGAGWGRPGSPPAAPPRAHSRMDPRTPYRPPAAGVGAVPAAAAGSAGAAASLGNATRGTRGGGDKRQLVYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTVVIKGVRVFDVAVLAPLLKDPALDLKVIHLVRDPRAVASSRIRSRHGLIRESLQVVRSRDPRAHRMPFLEAAGHKLGAKKEGMGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 17653 - protein, 484 aa, Homo sapiens
MKVFRRKALVLCAGYALLLVLTMLNLLDYKWHKEPLQQCNPDGPLGAAAGAAGGKLGAPRAASGRAAPCSCPFGPPHSLPPSRCRRRGDTLQPRQGWRGLRPLQAMALGAPEGVGDKRHWMYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTLVIKGVRVFDVAVLAPLLRDPALDLKVIHLVRDPRAVASSRIRSRHGLIRESLQVVRSRDPRAHRMPFLEAAGHKLGAKKEGVGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 17654 - protein, 219 aa, Homo sapiens
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 17655 - protein, 524 aa, Homo sapiens
METDTLLLWVLLLWVPGSTGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSLEGGGSIKQIEDKIEEILSKIYHIENEIARIKKLIGERGHDIERKCCVECPPCP

SEQ ID NO: 17656 - protein, 526 aa, Homo sapiens
METDTLLLWVLLLWVPGSTGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSLEGGGSIKQIEDKIEEILSKIYHIENEIARIKKLIGERGHDIERKCCVECPPCP

SEQ ID NO: 17657 - protein, 526 aa, Homo sapiens
METDTLLLWVLLLWVPGSTGEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSLEGGGSIKQIEDKIEEILSKIYHIENEIARIKKLIGERGHDIERKCCVECPPCP

SEQ ID NO: 17658 - protein, 525 aa, Homo sapiens
METDTLLLWVLLLWVPGSTGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSLEGGGSIKQIEDKIEEILSKIYHIENEIARIKKLIGERGHDIERKCCVECPPCP

SEQ ID NO: 17659 - protein, 448 aa, Artificial Sequence
  Description of Artificial Sequence: Synthetic polypeptide
EVQLVESGGGLVQPGGSLRLSCAASGFTFSNYWISWVRQAPGKGLEWVAEIRSESDASATHYAEAVKGRFTISRDNAKNSLYLQMNSLRAEDTAVYYCLAYFDYGLAIQNYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17660 - protein, 474 aa, Artificial Sequence
  Description of Artificial Sequence: Synthetic polypeptide
MDMRVPAQLLGLLLLWLRGARCQVQLVQSGAEVKKPGASVKVSCKASGYTFTDYYMYWVRQAPGQGLEWMGWISPNSGGTNYAQKFQGRVTMTRDTSISTAYMELSRLRSDDTAVYYCVRGGYSGYAGLYSHYYGMDVWGQGTTVTVSSASIKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSIFRWSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17661 - protein, 479 aa, Artificial Sequence
  Description of Artificial Sequence: Synthetic polypeptide
MDMRVPAQLLGLLLLWLRGARCEVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYYCTTDRTGYSISWSSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17662 - protein, 477 aa, Artificial Sequence
  Description of Artificial Sequence: Synthetic polypeptide
MDMRVPAQLLGLLLLWLRGARCQVQLVESGGGWQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGLAVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17663 - protein, 478 aa, Artificial Sequence
  Description of Artificial Sequence: Synthetic polypeptide
MDMRVPAQLLGLLLLWLRGARCEVQLVESGGGLVKPGGSLRLSCAASGYTFSTYSMNWVRQAPGKGLEWVSSISSSSSYRYYADSVKGRFTISRDNAKNSLYLQMSSLRAEDTAVYYCAREGVSGSSPYSISWYDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRWSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17664 - protein, 474 aa, Artificial Sequence
  Description of Artificial Sequence: Synthetic polypeptide
MDMRVPAQLLGLLLLWLRGARCQVQLVESGGGVVQPGRSLRLSCAASGFTFSSYGMHWVRQAPGKGLEWVAVIWYDGSNKYYADSVKGRFIISRDKSKNTLYLQMNSLRAEDTAVYYCARAGGIAAAGLYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVWDVSHEDPEVQFNWYVDGVEVHNAKTKPREEQFNSTFRVVSVLTVVHQDWLNGKEYKCKVSNKGLPAPIEKTISKIKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTIQKSLSLSPGK

SEQ ID NO: 17665 - protein, 109 aa, Artificial Sequence
  Description of Artificial Sequence: Synthetic polypeptide
QSLEESGGRLVTPGTPLTLTCTVSGLDLSSYYMQWVRQAPGKGLEWIGVIGINDNTYYASWAKGRFTISRASSTTVDLKMTSLTTEDTATYFCARGDIWGPGTLVTVSS

SEQ ID NO: 17666 - protein, 439 aa, Artificial Sequence
  Description of Artificial Sequence: Synthetic polypeptide
QSLEESGGRLVTPGTPLTLTCTVSGLDLSSYYMQWVRQAPGKGLEWIGVIGINDNTYYASWAKGRFTISRASSTTVDLKMTSLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17667 - protein, 441 aa, Artificial Sequence
  Description of Artificial Sequence: Synthetic polypeptide
EVQLVESGGGLVQPGGSLRLSCAVSGIGLSSYYMQWVRQAPGKGLEWVGVIGSDGKTYYATWAKGRFTISRDNSKTTVYLQMNSLRAEDTAVYFCTRGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17668 - protein, 439 aa, Artificial Sequence
  Description of Artificial Sequence: Synthetic polypeptide
QSLEESGGRLVTPGGSLTLTCTVSGIDVTNYYMQWVRQAPGKGLEWIGVIGVNGKRYYASWAKGRFTISKTSSTTVDLKMTSLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17669 - protein, 441 aa, Artificial Sequence
  Description of Artificial Sequence: Synthetic polypeptide
EVQLVESGGGLVQPGGSLRLSCAVSGIDVTNYYMQWVRQAPGKGLEWVGVIGVNGKRYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17670 - protein, 441 aa, Artificial Sequence
  Description of Artificial Sequence: Synthetic polypeptide
QSVEESGGGLVQPEGSLTLTCTASGFDFSSNAMWWVRQAPGKGLEWIGCIYNGDGSTYYASWVNGRFSISKTSSTTVTLQLNSLTVADTATYYCARDLDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17671 - protein, 478 aa, Artificial Sequence
  Description of Artificial Sequence: Synthetic polypeptide
MDMRVPAQLLGLLLLWLRGARCEVQLLESGGGLVQPGESLRLSCAASGFTFSSYAMSWVRQAPGKGLEWVSAISGSGGRTYYADSVKGRFTISRDNSKNTLYLQMNSLRAEDTAVYYCAKDQREVGPYSSGWYDYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17672 - protein, 441 aa, Artificial Sequence
  Description of Artificial Sequence: Synthetic polypeptide
EVQLVESGGGLVQPGGSLRLSCAVSGIGLSSYYMQWVRQAPGKGLEWVGVIGSDGKTYYATWAKGRFTISRDNSKTTVYLQMNSLRAEDTAVYFCTRGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17673 - protein, 441 aa, Artificial Sequence
  Description of Artificial Sequence: Synthetic polypeptide
EVQLVESGGGLVQPGGSLRLSCAVSGLDLSSYYMQWVRQAPGKGLEWVGVIGINDNTYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17674 - protein, 441 aa, Artificial Sequence
  Description of Artificial Sequence: Synthetic polypeptide
EVQLVESGGGLVQPGGSLRLSCAVSGLDLSSYYMQWVRQAPGKGLEWVGVIGINDNTYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17675 - protein, 439 aa, Artificial Sequence
  Description of Artificial Sequence: Synthetic polypeptide
QSLEESGGRLVTPGTPLTLTCSVSGIDLSGYYMNWVRQAPGKGLEWIGVIGINGATYYASWAKGRFTISKTSSTTVDLKMTSLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17676 - protein, 441 aa, Artificial Sequence
  Description of Artificial Sequence: Synthetic polypeptide
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17677 - protein, 441 aa, Artificial Sequence
  Description of Artificial Sequence: Synthetic polypeptide
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17678 - protein, 440 aa, Artificial Sequence
  Description of Artificial Sequence: Synthetic polypeptide
QEQLKESGGRLVTPGTSLTLTCTVSGIDLSNHYMQWVRQAPGKGLEWIGVVGINGRTYYASWAKGRFTISRTSSTTVDLKMTRLTTEDTATYFCARGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17679 - protein, 441 aa, Artificial Sequence
  Description of Artificial Sequence: Synthetic polypeptide
EVQLVESGGGLVQPGGSLRLSCAVSGIDLSNHYMQWVRQAPGKGLEWVGVVGINGRTYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17680 - protein, 439 aa, Artificial Sequence
  Description of Artificial Sequence: Synthetic polypeptide
QSLEESGGRLVTPGTPLTLTCTVSGIGLSSYYMQWVRQSPGRGLEWIGVIGSDGKTYYATWAKGRFTISKTSSTTVDLRMASLTTEDTATYFCTRGDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17681 - protein, 111 aa, Artificial Sequence
  Description of Artificial Sequence: Synthetic polypeptide
EVQLVESGGGLVQPGGSLRLSCAVSGLDLSSYYMQWVRQAPGKGLEWVGVIGINDNTYYASWAKGRFTISRDNSKTTVYLQMNSLRAEDTAVYFCARGDIWGQGTLVTVSS

SEQ ID NO: 17682 - protein, 478 aa, Artificial Sequence
  Description of Artificial Sequence: Synthetic polypeptide
MDMRVPAQLLGLLLLWLRGARCQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17683 - protein, 111 aa, Artificial Sequence; identical to SEQ ID NO: 17681
  Description of Artificial Sequence: Synthetic polypeptide

SEQ ID NO: 17684 - protein, 109 aa, Artificial Sequence
  Description of Artificial Sequence: Synthetic polypeptide
QSLEESGGRLVTPGTPLTLTCSVSGIDLSGYYMNWVRQAPGKGLEWIGVIGINGATYYASWAKGRFTISKTSSTTVDLKMTSLTTEDTATYFCARGDIWGPGTLVTVSS

SEQ ID NO: 17685 - protein, 111 aa, Artificial Sequence
  Description of Artificial Sequence: Synthetic polypeptide
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSS

SEQ ID NO: 17686 - protein, 111 aa, Artificial Sequence; identical to SEQ ID NO: 17685
  Description of Artificial Sequence: Synthetic polypeptide

SEQ ID NO: 17687 - protein, 110 aa, Artificial Sequence
  Description of Artificial Sequence: Synthetic polypeptide
QEQLKESGGRLVTPGTSLTLTCTVSGIDLSNHYMQWVRQAPGKGLEWIGVVGINGRTYYASWAKGRFTISRTSSTTVDLKMTRLTTEDTATYFCARGDIWGPGTLVTVSS

SEQ ID NO: 17688 - protein, 111 aa, Artificial Sequence
  Description of Artificial Sequence: Synthetic polypeptide
EVQLVESGGGLVQPGGSLRLSCAVSGIDLSNHYMQWVRQAPGKGLEWVGVVGINGRTYYASWAKGRFTISRDNSKTTVYLQMNSLRAEDTAVYFCARGDIWGQGTLVTVSS

SEQ ID NO: 17689 - protein, 109 aa, Artificial Sequence
  Description of Artificial Sequence: Synthetic polypeptide
QSLEESGGRLVTPGTPLTLTCTVSGIGLSSYYMQWVRQSPGRGLEWIGVIGSDGKTYYATWAKGRFTISKTSSTTVDLRMASLTTEDTATYFCTRGDIWGPGTLVTVSS

SEQ ID NO: 17690 - protein, 111 aa, Artificial Sequence
  Description of Artificial Sequence: Synthetic polypeptide
EVQLVESGGGLVQPGGSLRLSCAVSGIGLSSYYMQWVRQAPGKGLEWVGVIGSDGKTYYATWAKGRFTISRDNSKTTVYLQMNSLRAEDTAVYFCTRGDIWGQGTLVTVSS

SEQ ID NO: 17691 - protein, 109 aa, Artificial Sequence
  Description of Artificial Sequence: Synthetic polypeptide
QSLEESGGRLVTPGGSLTLTCTVSGIDVTNYYMQWVRQAPGKGLEWIGVIGVNGKRYYASWAKGRFTISKTSSTTVDLKMTSLTTEDTATYFCARGDIWGPGTLVTVSS

SEQ ID NO: 17692 - protein, 111 aa, Artificial Sequence
  Description of Artificial Sequence: Synthetic polypeptide
EVQLVESGGGLVQPGGSLRLSCAVSGIDVTNYYMQWVRQAPGKGLEWVGVIGVNGKRYYASWAKGRFTISRDNSKTTVYLQMNSLRAEDTAVYFCARGDIWGQGTLVTVSS

SEQ ID NO: 17693 - protein, 477 aa, Artificial Sequence
  Description of Artificial Sequence: Synthetic polypeptide
MDMRVPAQLLGLLLLWLRGARCEVQLVESGGGLVKPGGSLRLSCAASGFTFSNAWMSWVRQAPGKGLEWVGRIKSTTDGGTTDYAAPVKGRFTISRDDSKNTLYLQMNSLKTEDTAVYYCTTDRTGYSSWSSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSIFRWSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17694 - protein, 111 aa, Artificial Sequence
  Description of Artificial Sequence: Synthetic polypeptide
QSVEESGGGLVQPEGSLTLTCTASGFDFSSNAMWWVRQAPGKGLEWIGCIYNGDGSTYYASWVNGRFSISKTSSTTVTLQLNSLTVADTATYYCARDLDLWGPGTLVTVSS

SEQ ID NO: 17695 - protein, 111 aa, Artificial Sequence; identical to SEQ ID NO: 17690
  Description of Artificial Sequence: Synthetic polypeptide

SEQ ID NO: 17696 - protein, 478 aa, Artificial Sequence
  Description of Artificial Sequence: Synthetic polypeptide
MDMRVPAQLLGLLLLWLRGARCQVQLVQSGAEVKKPGASVKVSCKASGYTFTGYYMHWVRQAPGQGLEWMGWINPNSGGTNYAQKFQGRVTMTRDTSISTAYMELSRLRSDDTAVYFCARDQMSIIMLRGVFPPYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17697 - protein, 476 aa, Artificial Sequence
  Description of Artificial Sequence: Synthetic polypeptide
MDMRVPAQLLGLLLLWLRGARCQVQLVESGGGWQPGRSLRLSCCAASGFTFSSYGMHWVRQAPGKGLEWVAVISYDGSHESYADSVKGRFTISRDISKNTLYLQMNSLRAEDTAVYFCARERKRVTMSTLYYYFYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSIFRWSVLTVVHQDWLNGKEYKCKVSNKGLPAPTEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17698 - protein, 469 aa, Artificial Sequence
  Description of Artificial Sequence: Synthetic polypeptide
MDMRVPAQLLGLLLLWLRGARCEVQLVESGGGLVKPGRSLRLSCTASGFTFGDYAMSWFRQAPGKGLEWIGFIRSRAYGGIPEYAASVKGRFTISRDDSKTIAYLQMNSLKTEDTAVYFCARGRGIAARWDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSIFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17699 - protein, 478 aa, Artificial Sequence
  Description of Artificial Sequence: Synthetic polypeptide
MDMRVPAQLLGLLLLWLRGARCEVQLVESGGGLVKPGGSLRLSCAASGFTFSNAWMSWVRQAPGKGLEWVGRIKSKTDGGTTDYTAPVKGRFTISRDDSKNTLYLQMNSLKAEDTAVYYCTTDRTGYSSWSSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17700 - protein, 476 aa, Artificial Sequence
  Description of Artificial Sequence: Synthetic polypeptide
MDMRVPAQLLGLLLLWLRGARCEVQLVESGGGLVKPGGSLRLSCAASGFTFGNAWMSWVRQAPGKGLEWVGRIKSKTDGGTTDYAAPVKGRFTISRDDSKNTLYLQMNSLKIEDTAVYFCTTDRIGYSISWSSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKIKPREEQFNSIFRWSVLIWHQDWLNGKEYKCKVSNKGLPAPIEKYISKIKGQPREPQVYYLPPSREEMKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17701 - protein, 449 aa, Artificial Sequence; identical to SEQ ID NO: 12336
  Description of Artificial Sequence: Synthetic polypeptide

SEQ ID NO: 17702 - protein, 446 aa, Artificial Sequence
  Description of Artificial Sequence: Synthetic polypeptide
QVQLVQSGAEVKKPGASVKVSCKVSGFTLTELSIHWVRQAPGKGLEWMGGFDPEDGETIYAQKFQGRVTMTEDTSTDTAYMELTSLRSEDTAVYYCSTIFGVVTNFDNWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17703 - protein, 120 aa, Artificial Sequence
  Description of Artificial Sequence: Synthetic polypeptide
QVQLQESGPGLVKPSETLSLTCTVSGFSLIGYDLNWIRQPPGKGLEWIGIIWGDGTTDYNSAVKSRVTISKDTSKNQFSLKLSSVTAADTAVYYCARGGYWYATSYYFDYWGQGTLVTVS

SEQ ID NO: 17704 - protein, 214 aa, Artificial Sequence
  Description of Artificial Sequence: Synthetic polypeptide
EIVLTQSPATLSLSPGERATLSCKASKRVTTYVSWYQQKPGQAPRLLIYGASNRYLGIPARFSGSGSGTDFTLTISSLEPEDFAVYYCSQSYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17705 - protein, 238 aa, Artificial Sequence
  Description of Artificial Sequence: Synthetic polypeptide
MDMRVPAQLLGLLLLWLRGARCQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17706 - protein, 238 aa, Artificial Sequence
  Description of Artificial Sequence: Synthetic polypeptide
MDMRVPAQLLGLLLLWLRGARCQSVLTQPPSASGTPGQRVTISCSGSSSNIGSNTVNWYQQLPGTAPKLLIYTNNQRPSGVPDRFSGSKSGTSASLAISGLQSEDEADFYCAARDESLNGVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17707 - protein, 236 aa, Artificial Sequence
  Description of Artificial Sequence: Synthetic polypeptide
MDMRVPAQLLGLLLLWLRGARCDIQMTQSPSSLSASVGDRVTITCRASQGIRNDLGWFQQKPGKAPKRLIYAASSLQSGVPSRFSGSGSGTEFTLTISSLQPEDLATYYCLQYNIYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17708 - protein, 237 aa, Artificial Sequence
  Description of Artificial Sequence: Synthetic polypeptide
MDMRVPAQLLGLLLLWLRGARCQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAWFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17709 - protein, 238 aa, Artificial Sequence
  Description of Artificial Sequence: Synthetic polypeptide
MDMRVPAQLLGLLLLWLRGARCQSVLTQPPSVSEAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17710 - protein, 238 aa, Artificial Sequence
  Description of Artificial Sequence: Synthetic polypeptide
MDMRVPAQLLGLLLLWLRGARCQSVLTQPPSASGIPGQRVTISCSGSSSNIGSNYVYWYQQLPGAAPKLLIFRSNQRPSGVPDRFSGSKSGTSASLAISGLRSEDEADYYCAAWDDSLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17711 - protein, 236 aa, Artificial Sequence
  Description of Artificial Sequence: Synthetic polypeptide
MDMRVPAQLLGLLLLWLRGARCSSELTQDPTVSVALGQTVKITCQGDSLRSFYASWYQQKPGQAPVLVFYGKNNRPSGIPDRFSGSSSGNTASLTITGAQAEDEADYYCNSRDSSVYHLVLGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17712 - protein, 241 aa, Artificial Sequence
  Description of Artificial Sequence: Synthetic polypeptide
MDMRVPAQLLGLLLLWLRGARCDIILAQTPLSLSVTPGQPASISCKSSQSLLHSAGKTYLYWYLQKPGQPPQLLIYEVSNRFSGVPDRFSGSGSGTDFTLKISRVEAEDVGIYYCMQSFPLPLTFGGGIKVEIKRTVAAPSVFIFPPSDEQLKSGTASVVCLLNNFYPREAKVQWKVDNALQSGNSQESVTEQDSKDSIYSLSSTLTLSKADYEKHKVYACEVTHQGLSSPVTKSFNRGEC

SEQ ID NO: 17713 - protein, 241 aa, Artificial Sequence
  Description of Artificial Sequence: Synthetic polypeptide
MDMRVPAQLLGLLLLWLRGARCDIVMTQSPLSLPVTPGEPASISCRSSQSLLHSFGYNYLDWYLQKPGQSPQLLIYLGSNRASGVPDRFSGSGSGTDFTLKISRVEAEDVGVYYCMQALQTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17714 - protein, 241 aa, Artificial Sequence
  Description of Artificial Sequence: Synthetic polypeptide
MDMRVPAQLLGLLLLWLRGARCDIILTQTPLSLSVTPGQPASISCKSSQSLLHSDGKTYLYWYLQKPGQPPQLLIYEVSNRFSGEPDRFSGSGSGTDFTLKISRVEAEDVGTYYCMQSFPLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17715 - protein, 238 aa, Artificial Sequence
  Description of Artificial Sequence: Synthetic polypeptide
MDMRVPAQLLGLLLLWLRGARCQSVLTQPPSVSAAPGQKVTISCSGSSSNIGNNYVSWYQQFPGTAPKLLIYDNNKRPSGIPDRFSGSKSGTSATLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17716 - protein, 238 aa, Artificial Sequence
  Description of Artificial Sequence: Synthetic polypeptide
MDMRVPAQLLGLLLLWLRGARCQSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17717 - protein, 238 aa, Artificial Sequence
  Description of Artificial Sequence: Synthetic polypeptide
MDMRVPAQLLGLLLLWLRGARCQSVLTQPPSASGIPGQRVTISCSGSSSNIGSNYVYWYQQLPGAAPKLLIFRNNQRPSGVPDRFSGSKSGTSASLAISGLRSEDEADYYCAAWDDSLSGWVFGGGIKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 17718 - protein, 241 aa, Artificial Sequence
  Description of Artificial Sequence: Synthetic polypeptide
MDMRVPAQLLGLLLLWLRGARCDITLTQTPLSLSVSPGQPASISCKSSQSLLHSDGRNYLYWYLQKPGQPPQLLIYEVSNRFSGLPDRFSGSGSGTDFTLKISRVEAEDVGIYYCMQSFPLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17719 - protein, 236 aa, Artificial Sequence
  Description of Artificial Sequence: Synthetic polypeptide
MDMRVPAQLLGLLLLWLRGARCDIQMTQSPSSLSASVGDRVTITCRASQGIRKDLGWYQQKPGKAPKRLIYGASSLQSGVPSRFSGSGSGTEFTLTISSLQPEDFATYYCLQYNSFPWTFGQGTKVEIKRTVAAPSVFIFPPSDEQLKSGTASVVCLLNNFYPREAKVQWKVDNALQSGNSQESVTEQDSKDSIYSLSSTLTLSKADYEKHKVYACEVTHQGLSSPVIKSFNRGEC

SEQ ID NO: 17720 - protein, 235 aa, Artificial Sequence
  Description of Artificial Sequence: Synthetic polypeptide
METPAQLLFLLLLWLPDTTGEIVLTQSPGTLSLSPGERATLSCRASQSVSSGYLTWYQQKPGQAPRLLIYGASSRATGIPDRFSGSGSGTDFTLTISRLEPEDFAVYYCQQYGNSLCRFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17721 - protein, 235 aa, Artificial Sequence
  Description of Artificial Sequence: Synthetic polypeptide
METPAQLLFLLLLWLPDTTGEIVLTQSPGTLSLSPGERATLSCRASQSVSSGYLTWYQQKPGQAPRLLIYGASSRATGIPDRFSGSGSGTDFTLTISRLEPEDFAVYYCQQYGNSLSRFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17722 - protein, 113 aa, Artificial Sequence
  Description of Artificial Sequence: Synthetic polypeptide
QVLTQTASPVSAAVGSTVTINCQASQSVYDNNYLAWYQQKPGQPPKQLIYSTSTLASGVSSRFKGSGSGTQFTLTISDLECADAATYYCLGSYDCSSGDCFVFGGGTEVVVKR

SEQ ID NO: 17723 - protein, 219 aa, Artificial Sequence
  Description of Artificial Sequence: Synthetic polypeptide
QVLTQTASPVSAAVGSTVTINCQASQSVYDNNYLAWYQQKPGQPPKQLIYSTSTLASGVSSRFKGSGSGTQFTLTISDLECADAATYYCLGSYDCSSGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17724 - protein, 219 aa, Artificial Sequence
  Description of Artificial Sequence: Synthetic polypeptide
QVLTQSPSSLSASVGDRVTINCQASQNVYNNNYLAWYQQKPGKVPKQLIYSTSTLASGVPSRFSGSGSGTDFTLTISSLQPEDVATYYCLGSYDCSRGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17725 - protein, 219 aa, Artificial Sequence
  Description of Artificial Sequence: Synthetic polypeptide
QVLTQTASPVSPAVGSTVTINCRASQSVYYNNYLAWYQQKPGQPPKQLIYSTSTLASGVSSRFKGSGSGTQFTLTISDVQCDDAATYYCLGSYDCSNGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17726 - protein, 219 aa, Artificial Sequence
  Description of Artificial Sequence: Synthetic polypeptide
QVLTQSPSSLSASVGDRVTINCRASQSVYYNNYLAWYQQKPGKVPKQLIYSTSTLASGVPSRFSGSGSGTDFTLTISSLQPEDVATYYCLGSYDCSNGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17727 - protein, 219 aa, Artificial Sequence
  Description of Artificial Sequence: Synthetic polypeptide
AIVMTQTPSSKSVPVGDTVTINCQASESLYNNNALAWFQQKPGQPPKRLIYDASKLASGVPSRFSGGGSGTQFTLTISGVQCDDAATYYCGGYRSDSVDGVAFAGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17728 - protein, 219 aa, Artificial Sequence; identical to SEQ ID NO: 17724
  Description of Artificial Sequence: Synthetic polypeptide

SEQ ID NO: 17729 - protein, 219 aa, Artificial Sequence
  Description of Artificial Sequence: Synthetic polypeptide
QVLTQSPSSLSASVGDRVTINCQASQSVYDNNYLAWYQQKPGKVPKQLIYSTSTLASGVPSRFSGSGSGTDFTLTISSLQPEDVATYYCLGSYDCSSGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17730 - protein, 219 aa, Artificial Sequence; identical to SEQ ID NO: 17729
  Description of Artificial Sequence: Synthetic polypeptide

SEQ ID NO: 17731 - protein, 219 aa, Artificial Sequence
  Description of Artificial Sequence: Synthetic polypeptide
QVLTQTPSPVSAAVGSTVTINCQASQSVYHNTYLAWYQQKPGQPPKQLIYDASTLASGVPSRFSGSGSGTQFTLTISGVQCNDAAAYYCLGSYDCTNGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17732 - protein, 219 aa, Artificial Sequence
  Description of Artificial Sequence: Synthetic polypeptide
QVLTQSPSSLSASVGDRVTINCQASQSVYHNTYLAWYQQKPGKVPKQLIYDASTLASGVPSRFSGSGSGTDFTLTISSLQPEDVATYYCLGSYDCTNGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17733 - protein, 219 aa, Artificial Sequence; identical to SEQ ID NO: 17732
  Description of Artificial Sequence: Synthetic polypeptide

SEQ ID NO: 17734 - protein, 219 aa, Artificial Sequence
  Description of Artificial Sequence: Synthetic polypeptide
QVLTQTASPVSAAVGSTVTINCQASQSVYNYNYLAWYQQKPGQPPKQLIYSTSTLASGVSSRFKGSGSGTQFTLTISDVQCDDAATYYCLGSYDCSTGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17735 - protein, 219 aa, Artificial Sequence
  Description of Artificial Sequence: Synthetic polypeptide
QVLTQSPSSLSASVGDRVTINCQASQSVYNYNYLAWYQQKPGKVPKQLIYSTSTLASGVPSRFSGSGSGTDFTLTISSLQPEDVATYYCLGSYDCSTGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17736 - protein, 219 aa, Artificial Sequence
  Description of Artificial Sequence: Synthetic polypeptide
QVLTQTPSPVSAAVGSTVTINCQASQNVYNNNYLAWYQQKPGQPPKQLIYSTSTLASGVSSRFRGSGSGTQFTLTISDVQCDDAATYYCLGSYDCSRGDCFVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17737 - protein, 113 aa, Artificial Sequence
  Description of Artificial Sequence: Synthetic polypeptide
QVLTQSPSSLSASVGDRVTINCQASQSVYDNNYLAWYQQKPGKVPKQLIYSTSTLASGVPSRFSGSGSGTDFTLTISSLQPEDVATYYCLGSYDCSSGDCFVFGGGTKVEIKR

SEQ ID NO: 17738 - protein, 113 aa, Artificial Sequence; identical to SEQ ID NO: 17737
  Description of Artificial Sequence: Synthetic polypeptide

SEQ ID NO: 17739 - protein, 113 aa, Artificial Sequence
  Description of Artificial Sequence: Synthetic polypeptide
QVLTQTPSPVSAAVGSTVTINCQASQSVYHNTYLAWYQQKPGQPPKQLIYDASTLASGVPSRFSGSGSGTQFTLTISGVQCNDAAAYYCLGSYDCTNGDCFVFGGGTEVVVKR

SEQ ID NO: 17740 - protein, 113 aa, Artificial Sequence
  Description of Artificial Sequence: Synthetic polypeptide
QVLTQSPSSLSASVGDRVTINCQASQSVYHNTYLAWYQQKPGKVPKQLIYDASTLASGVPSRFSGSGSGTDFTLTISSLQPEDVATYYCLGSYDCTNGDCFVFGGGTKVEIKR

SEQ ID NO: 17741 - protein, 113 aa, Artificial Sequence; identical to SEQ ID NO: 17740
  Description of Artificial Sequence: Synthetic polypeptide

SEQ ID NO: 17742 - protein, 113 aa, Artificial Sequence
  Description of Artificial Sequence: Synthetic polypeptide
QVLTQTASPVSAAVGSTVTINCQASQSVYNYNYLAWYQQKPGQPPKQLIYSTSTLASGVSSRFKGSGSGTQFTLTISDVQCDDAATYYCLGSYDCSTGDCFVFGGGTEVVVKR

SEQ ID NO: 17743 - protein, 113 aa, Artificial Sequence
  Description of Artificial Sequence: Synthetic polypeptide
QVLTQSPSSLSASVGDRVTINCQASQSVYNYNYLAWYQQKPGKVPKQLIYSTSTLASGVPSRFSGSGSGTDFTLTISSLQPEDVATYYCLGSYDCSTGDCFVFGGGTKVEIKR

SEQ ID NO: 17744 - protein, 113 aa, Artificial Sequence
  Description of Artificial Sequence: Synthetic polypeptide
QVLTQTPSPVSAAVGSTVTINCQASQNVYNNNYLAWYQQKPGQPPKQLIYSTSTLASGVSSRFRGSGSGTQFTLTISDVQCDDAATYYCLGSYDCSRGDCFVFGGGTEVVVKR

SEQ ID NO: 17745 - protein, 113 aa, Artificial Sequence
  Description of Artificial Sequence: Synthetic polypeptide
QVLTQSPSSLSASVGDRVTINCQASQNVYNNNYLAWYQQKPGKVPKQLIYSTSTLASGVPSRFSGSGSGTDFTLTISSLQPEDVATYYCLGSYDCSRGDCFVFGGGTKVEIKR

SEQ ID NO: 17746 - protein, 113 aa, Artificial Sequence
  Description of Artificial Sequence: Synthetic polypeptide
QVLTQTASPVSPAVGSTVTINCRASQSVYYNNYLAWYQQKPGQPPKQLIYSTSTLASGVSSRFKGSGSGTQFTLTISDVQCDDAATYYCLGSYDCSNGDCFVFGGGTEVVVKR

SEQ ID NO: 17747 - protein, 113 aa, Artificial Sequence
  Description of Artificial Sequence: Synthetic polypeptide
QVLTQSPSSLSASVGDRVTINCRASQSVYYNNYLAWYQQKPGKVPKQLIYSTSTLASGVPSRFSGSGSGTDFTLTISSLQPEDVATYYCLGSYDCSNGDCFVFGGGTKVEIKR

SEQ ID NO: 17748 - protein, 113 aa, Artificial Sequence
  Description of Artificial Sequence: Synthetic polypeptide
AIVMTQTPSSKSVPVGDTVTINCQASESLYNNNALAWFQQKPGQPPKRLIYDASKLASGVPSRFSGGGSGTQFTLTISGVQCDDAATYYCGGYRSDSVDGVAFAGGTEVVVKR

SEQ ID NO: 17749 - protein, 113 aa, Artificial Sequence; identical to SEQ ID NO: 17745
  Description of Artificial Sequence: Synthetic polypeptide

SEQ ID NO: 17750 - protein, 108 aa, Artificial Sequence; identical to SEQ ID NO: 14208
  Description of Artificial Sequence: Synthetic polypeptide

SEQ ID NO: 17751 - protein, 214 aa, Artificial Sequence; identical to SEQ ID NO: 9500
  Description of Artificial Sequence: Synthetic polypeptide

SEQ ID NO: 17752 - protein, 214 aa, Artificial Sequence
  Description of Artificial Sequence: Synthetic polypeptide
DIQMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17753 - protein, 109 aa, Artificial Sequence
  Description of Artificial Sequence: Synthetic polypeptide
DIQMTQSPSSLSASVGDRVTITCRASQSISNNLNWYQQKPGKAPKLLIYYTSRFHSGVPSRFSGSGSGTDFTFTISSLQPEDIATYYCQQEHTLPYTFGQGTKLEIKRT

SEQ ID NO: 17754 - protein, 122 aa, Artificial Sequence
  Description of Artificial Sequence: Synthetic polypeptide
EVQLVESGGGLVQPGGSLRLSCAASGFTFSNYWISWVRQAPGKGLEWVAEIRSESDASATHYAEAVKGRFTISRDNAKNSLYLQMNSLRAEDTAVYYCLAYFDYGLAIQNYWGQGTLVTVSS

SEQ ID NO: 17755 - protein, 107 aa, Artificial Sequence
  Description of Artificial Sequence: Synthetic polypeptide
EIVLTQSPATLSLSPGERATLSCKASKRVTTYVSWYQQKPGQAPRLLIYGASNRYLGIPARFSGSGSGTDFTLTISSLEPEDFAVYYCSQSYNYPYTFGQGTKLEIK

SEQ ID NO: 17756 - protein, 213 aa, Artificial Sequence
  Description of Artificial Sequence: Synthetic polypeptide
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 17757 - protein, 218 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSGTAALGCLVKDYFPEPVTVSWNSGALTSGVHTFPAVLQSSGLYSLSSVVTVPSSSLGTQTYICNVNHKPSNTKVDKKVEPK

SEQ ID NO: 17758 - protein, 213 aa, Artificial Sequence; identical to SEQ ID NO: 17756
  Description of Artificial Sequence: Synthetic polypeptide

SEQ ID NO: 17759 - protein, 218 aa, Artificial Sequence; identical to SEQ ID NO: 17757
  Description of Artificial Sequence: Synthetic polypeptide

SEQ ID NO: 17760 - protein, 431 aa, Artificial Sequence
  Description of Artificial Sequence: Synthetic polypeptide
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 17761 - protein, 526 aa, Artificial Sequence
  Description of Artificial Sequence: Synthetic polypeptide
GRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPGPGDKTHTCPLCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKATPPVLDSDGSFFLYSKLTVDKSRWQQGNVFSCSVMHEALHNHYTQKSLSLSPGK

SEQ ID NO: 17762 - protein, 107 aa, Artificial Sequence [sequence omitted]

SEQ ID NO: 17763 - protein, 223 aa, Artificial Sequence
  Description of Artificial Sequence: Synthetic polypeptide
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 17764 - protein, 449 aa, Artificial Sequence
  Description of Artificial Sequence: Synthetic polypeptide
QLQLQESGPGLVKPSETLSLTCTVSGGSITSSSYYWGWIRQPPGKGLEWIGSIYYRGSTNYNPSLKSRVTISVDSSKNQFYLKVSSVTAVDTAVYYCARQNGAARPSWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17765 - protein, 224 aa, Artificial Sequence
  Description of Artificial Sequence: Synthetic polypeptide
EVQLVESGGGSVQPGGSLRLSCTASGFTISRSYWICWVRQAPGKGLEWVGCIYGDNDITPLYANWAKGRFTISRDTSKNTVYLQMNSLRAEDTATYYCARLGYADYAYDLWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 17766 - protein, 326 aa, Artificial Sequence
  Description of Artificial Sequence: Synthetic polypeptide
EVQLVESGGGSVQPGGSLRLSCTASGFTISRSYWICWVRQAPGKGLEWVGCIYGDNDITPLYANWAKGRFTISRDTSKNTVYLQMNSLRAEDTATYYCARLGYADYAYDLWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17767 - protein, 221 aa, Artificial Sequence
  Description of Artificial Sequence: Synthetic polypeptide
QVQLVESGGGVVQPGRSLRLSCAASGFTFSVYGMNWVRQAPGKGLEWVAIIWYDGDNQYYADSVKGRFTISRDNSKNTLYLQMNGLRAEDTAVYYCARDLRTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 17768 - protein, 323 aa, Artificial Sequence
  Description of Artificial Sequence: Synthetic polypeptide
QVQLVESGGGVVQPGRSLRLSCAASGFTFSVYGMNWVRQAPGKGLEWVAIIWYDGDNQYYADSVKGRFTISRDNSKNTLYLQMNGLRAEDTAVYYCARDLRTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17769 - protein, 325 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17770 - protein, 325 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17771 - protein, 325 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAASGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17772 - protein, 327 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGACGVYHREAQSGKYKLTYAEAKAVCEFEGGHLATYKQLECARKIGFHVCAAGWMAKGRVGYPIVKPGPNCGFGKTGIIDYGIRLNRSERWDAYCYNPHA

SEQ ID NO: 17773 - protein, 325 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLCTYKQLEAARKIGFHVCAAGWMAKGRVGYPIVKPGPNCGFGKTGIIDYGIRLNRSERWDAYCCNPHA

SEQ ID NO: 17774 - protein, 219 aa, Artificial Sequence
  Description of Artificial Sequence: Synthetic polypeptide
EVQLVQSGAEVKKPGSSVKVSCKASGGTFSSYAISWVRQAPGQGLEWMGGIGPFFGTANYAQKFQGRVTITADESTSTAYMELSSLRSEDTAVYYCARDTPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 17775 - protein, 321 aa, Artificial Sequence
  Description of Artificial Sequence: Synthetic polypeptide
EVQLVQSGAEVKKPGSSVKVSCKASGGTFSSYAISWVRQAPGQGLEWMGGIGPFFGTANYAQKFQGRVTITADESTSTAYMELSSLRSEDTAVYYCARDTPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17776 - protein, 220 aa, Artificial Sequence; identical to SEQ ID NO: 4740
  Description of Artificial Sequence: Synthetic polypeptide

SEQ ID NO: 17777 - protein, 322 aa, Artificial Sequence
  Description of Artificial Sequence: Synthetic polypeptide
EVQLVQSGAEVKKPGSSVKVSCKASGGTFSSYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17778 - protein, 220 aa, Artificial Sequence
  Description of Artificial Sequence: Synthetic polypeptide
EVQLVQSGAEVKKPGESLKISCKGSGYSFTSYWIGWVRQMPGKGLEWMGWIDPYRSEIRYSPSFQGQVTISADKSISTAYLQWSSLKASDTAMYYCARVSSEPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 17779 - protein, 322 aa, Artificial Sequence
  Description of Artificial Sequence: Synthetic polypeptide
EVQLVQSGAEVKKPGESLKISCKGSGYSFTSYWIGWVRQMPGKGLEWMGWIDPYRSEIRYSPSFQGQVTISADKSISTAYLQWSSLKASDTAMYYCARVSSEPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17780 - protein, 223 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 17781 - protein, 452 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 17782 - protein, 555 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17783 - protein, 450 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17784 - protein, 450 aa, Artificial Sequence; identical to SEQ ID NO: 17783
  Description of Artificial Sequence: Synthetic polypeptide

SEQ ID NO: 17785 - protein, 325 aa, Artificial Sequence; identical to SEQ ID NO: 17770
  Description of Artificial Sequence: Synthetic polypeptide

SEQ ID NO: 17786 - protein, 326 aa, Artificial Sequence
  Description of Artificial Sequence: Synthetic polypeptide
VYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKGGGSEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGS

SEQ ID NO: 17787 - protein, 325 aa, Artificial Sequence; identical to SEQ ID NO: 17770
  Description of Artificial Sequence: Synthetic polypeptide

SEQ ID NO: 17788 - protein, 225 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGS

SEQ ID NO: 17789 - protein, 325 aa, Artificial Sequence; identical to SEQ ID NO: 17769
  Description of Artificial Sequence: Synthetic polypeptide

SEQ ID NO: 17790 - protein, 633 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAGGGGGGSGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGGGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGGGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17791 - protein, 427 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGSGGGGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGGGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17792 - protein, 451 aa, Artificial Sequence
  Description of Artificial Sequence: Synthetic polypeptide
EVQLVQSGAEVKKPGESLKISCQSFGYIFIDHTIHWMRQMPGQGLEWMGAISPRHDITKYNEMFRGQVTISADKSSSTAYLQWSSLKASDTAMYFCARGGFYGSTIWFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17793 - protein, 121 aa, Artificial Sequence
  Description of Artificial Sequence: Synthetic polypeptide
EVQLVQSGAEVKKPGESLKISCQSFGYIFIDHTIHWMRQMPGQGLEWMGAISPRHDITKYNEMFRGQVTISADKSSSTAYLQWSSLKASDTAMYFCARGGFYGSTIWFDFWGQGTMVTVSS

SEQ ID NO: 17794 - protein, 115 aa, Artificial Sequence
  Description of Artificial Sequence: Synthetic polypeptide
QVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSS

SEQ ID NO: 17795 - protein, 115 aa, Artificial Sequence [sequence omitted]

SEQ ID NO: 17796 - protein, 115 aa, Artificial Sequence; identical to SEQ ID NO: 17794
  Description of Artificial Sequence: Synthetic polypeptide

SEQ ID NO: 17797 - protein, 115 aa, Artificial Sequence; identical to SEQ ID NO: 17794
  Description of Artificial Sequence: Synthetic polypeptide

SEQ ID NO: 17798 - protein, 115 aa, Artificial Sequence; identical to SEQ ID NO: 17794
  Description of Artificial Sequence: Synthetic polypeptide

SEQ ID NO: 17799 - protein, 115 aa, Artificial Sequence; identical to SEQ ID NO: 17794
  Description of Artificial Sequence: Synthetic polypeptide

SEQ ID NO: 17800 - protein, 115 aa, Artificial Sequence; identical to SEQ ID NO: 17794
  Description of Artificial Sequence: Synthetic polypeptide

SEQ ID NO: 17801 - protein, 115 aa, Artificial Sequence; identical to SEQ ID NO: 17794
  Description of Artificial Sequence: Synthetic polypeptide

SEQ ID NO: 17802 - protein, 115 aa, Artificial Sequence; identical to SEQ ID NO: 17794
  Description of Artificial Sequence: Synthetic polypeptide

SEQ ID NO: 17803 - protein, 115 aa, Artificial Sequence
  Description of Artificial Sequence: Synthetic polypeptide
QVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVANWGQGTLVTVSS

SEQ ID NO: 17804 - protein, 115 aa, Artificial Sequence
  Description of Artificial Sequence: Synthetic polypeptide
QVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVQNWGQGTLVTVSS

SEQ ID NO: 17805 - protein, 115 aa, Artificial Sequence
  Description of Artificial Sequence: Synthetic polypeptide
QVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNAWGQGTLVTVSS

SEQ ID NO: 17806 - protein, 115 aa, Artificial Sequence
  Description of Artificial Sequence: Synthetic polypeptide
QVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNQWGQGTLVTVSS

SEQ ID NO: 17807 - protein, 121 aa, Artificial Sequence; identical to SEQ ID NO: 6450
  Description of Artificial Sequence: Synthetic polypeptide

SEQ ID NO: 17808 - protein, 121 aa, Artificial Sequence; identical to SEQ ID NO: 6451
  Description of Artificial Sequence: Synthetic polypeptide

SEQ ID NO: 17809 - protein, 121 aa, Artificial Sequence
  Description of Artificial Sequence: Synthetic polypeptide
EVQLVESGGGSVQPGGSLRLSCTASGFTISRSYWICWVRQAPGKGLEWVGCIYGDNDITPLYANWAKGRFTISRDTSKNTVYLQMNSLRAEDTATYYCARLGYADYAYDLWGQGTTVTVSS

SEQ ID NO: 17810 - protein, 118 aa, Artificial Sequence [sequence omitted]

SEQ ID NO: 17811 - protein, 116 aa, Artificial Sequence
  Description of Artificial Sequence: Synthetic polypeptide
EVQLVQSGAEVKKPGSSVKVSCKASGGTFSSYAISWVRQAPGQGLEWMGGIGPFFGTANYAQKFQGRVTITADESTSTAYMELSSLRSEDTAVYYCARDTPYFDYWGQGTLVTVSS

SEQ ID NO: 17812 - protein, 117 aa, Artificial Sequence
  Description of Artificial Sequence: Synthetic polypeptide
EVQLVQSGAEVKKPGSSVKVSCKASGGTFNSYAISWVRQAPGQGLEWMGRIIPIFGTANYAQKFQGRVTITADESTSTAYMELSSLRSEDTAVYYCARHGGYSFDSWGQGTLVTVSS

SEQ ID NO: 17813 - protein, 120 aa, Artificial Sequence
  Description of Artificial Sequence: Synthetic polypeptide
EVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 17814 - protein, 117 aa, Artificial Sequence
  Description of Artificial Sequence: Synthetic polypeptide
EVQLVQSGAEVKKPGESLKISCKGSGYSFTSYWIGWVRQMPGKGLEWMGWIDPYRSEIRYSPSFQGQVTISADKSISTAYLQWSSLKASDTAMYYCARVSSEPFDSWGQGTLVTVSS

SEQ ID NO: 17815 - protein, 214 aa, Artificial Sequence
  Description of Artificial Sequence: Synthetic polypeptide
DIQVTQSPSSLSASVGDRVTITCITSTDIDDDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17816 - protein, 214 aa, Artificial Sequence; identical to SEQ ID NO: 17815
  Description of Artificial Sequence: Synthetic polypeptide

SEQ ID NO: 17817 - protein, 215 aa, Artificial Sequence
  Description of Artificial Sequence: Synthetic polypeptide
EIVLTQSPDTISLSPGERATLSCRASQSISSIYLAWYQQKPGQAPRLLIYGASSRVTGIPDRFSVSGSGTDFTLTISRLEPEDFAVYYCQHYGISPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17818 - protein, 219 aa, Artificial Sequence
  Description of Artificial Sequence: Synthetic polypeptide
EIVMTQSPSTLSASVGDRVIITCQSSQSVYGNIWMAWYQQKPGRAPKLLIYQASKLASGVPSRFSGSGSGAEFTLTISSLQPDDFATYYCQGNFNTGDRYAFGQGTKLTVLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17819 - protein, 214 aa, Artificial Sequence; identical to SEQ ID NO: 9515
  Description of Artificial Sequence: Synthetic polypeptide

SEQ ID NO: 17820 - protein, 214 aa, Artificial Sequence; identical to SEQ ID NO: 9515
  Description of Artificial Sequence: Synthetic polypeptide

SEQ ID NO: 17821 - protein, 218 aa, Artificial Sequence
  Description of Artificial Sequence: Synthetic polypeptide
EIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17822 - protein, 320 aa, Artificial Sequence
  Description of Artificial Sequence: Synthetic polypeptide
EIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17823 - protein, 223 aa, Artificial Sequence
  Description of Artificial Sequence: Synthetic polypeptide
GGGGGEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17824 - protein, 319 aa, Artificial Sequence
  Description of Artificial Sequence: Synthetic polypeptide
VYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKGGGSEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17825 - protein, 320 aa, Artificial Sequence; identical to SEQ ID NO: 17822
  Description of Artificial Sequence: Synthetic polypeptide

SEQ ID NO: 17826 - protein, 422 aa, Artificial Sequence
  Description of Artificial Sequence: Synthetic polypeptide
EIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17827 - protein, 319 aa, Artificial Sequence; identical to SEQ ID NO: 17824
  Description of Artificial Sequence: Synthetic polypeptide

SEQ ID NO: 17828 - protein, 218 aa, Artificial Sequence; identical to SEQ ID NO: 17821
  Description of Artificial Sequence: Synthetic polypeptide

SEQ ID NO: 17829 - protein, 218 aa, Artificial Sequence; identical to SEQ ID NO: 17821
  Description of Artificial Sequence: Synthetic polypeptide

SEQ ID NO: 17830 - protein, 320 aa, Artificial Sequence; identical to SEQ ID NO: 17822
  Description of Artificial Sequence: Synthetic polypeptide

SEQ ID NO: 17831 - protein, 218 aa, Artificial Sequence; identical to SEQ ID NO: 17821
  Description of Artificial Sequence: Synthetic polypeptide

SEQ ID NO: 17832 - protein, 214 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAAAYYCHQSSSLPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17833 - protein, 214 aa, Artificial Sequence; identical to SEQ ID NO: 7462
  Description of Artificial Sequence: Synthetic polypeptide

SEQ ID NO: 17834 - protein, 214 aa, Artificial Sequence; identical to SEQ ID NO: 7446
  Description of Artificial Sequence: Synthetic polypeptide

SEQ ID NO: 17835 - protein, 107 aa, Artificial Sequence
  Description of Artificial Sequence: Synthetic polypeptide
SYVLTQPPSVSVAPGKTARITCSGDKLGDHYAYWYQQKPGQAPVLVIYDDSKRPSGIPERFSGSNSGNTATLTISRVEAGDEADYYCATWTFEGDYVFGGGTKLTVL

SEQ ID NO: 17836 - protein, 214 aa, Artificial Sequence
  Description of Artificial Sequence: Synthetic polypeptide
ETTVTQSPSFLSASVGDRVTITCITTTDIDDDMNWFQQEPGKAPKLLISEGNILRPGVPSRFSSSGYGTDFTLTISKLQPEDFATYYCLQSDNLPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17837 - protein, 107 aa, Artificial Sequence
  Description of Artificial Sequence: Synthetic polypeptide
ETTVTQSPSFLSASVGDRVTITCITTTDIDDDMNWFQQEPGKAPKLLISEGNILRPGVPSRFSSSGYGTDFTLTISKLQPEDFATYYCLQSDNLPFTFGQGTKLEIK

SEQ ID NO: 17838 - protein, 107 aa, Artificial Sequence
  Description of Artificial Sequence: Synthetic polypeptide
DIQVTQSPSSLSASVGDRVTITCITSTDIDDDMNWYQQKPGKVPKLLISGGNTLRPGVPSRFSGSGSGTDFTLTISSLQPEDVATYYCLQSDSLPYTFGQGTKLEIK

SEQ ID NO: 17839 - protein, 107 aa, Artificial Sequence
  Description of Artificial Sequence: Synthetic polypeptide
DIQVTQSPSSLSASVGDRVTITCITSTDIDDDMAWYQQKPGKVPKLLISGGNTLRPGVPSRFSGSGSGTDFTLTISSLQPEDVATYYCLQSDSLPYTFGQGTKLEIK

SEQ ID NO: 17840 - protein, 107 aa, Artificial Sequence
  Description of Artificial Sequence: Synthetic polypeptide
DIQVTQSPSSLSASVGDRVTITCITSTDIDDDMQWYQQKPGKVPKLLISGGNTLRPGVPSRFSGSGSGTDFTLTISSLQPEDVATYYCLQSDSLPYTFGQGTKLEIK

SEQ ID NO: 17841 - protein, 107 aa, Artificial Sequence
  Description of Artificial Sequence: Synthetic polypeptide
DIQVTQSPSSLSASVGDRVTITCITSTDIDDDMNWYQQKPGKVPKLLISGGSTLRPGVPSRFSGSGSGTDFTLTISSLQPEDVATYYCLQSDSLPYTFGQGTKLEIK

SEQ ID NO: 17842 - protein, 107 aa, Artificial Sequence
  Description of Artificial Sequence: Synthetic polypeptide
DIQVTQSPSSLSASVGDRVTITCITSTDIDDDMNWYQQKPGKVPKLLISGGATLRPGVPSRFSGSGSGTDFTLTISSLQPEDVATYYCLQSDSLPYTFGQGTKLEIK

SEQ ID NO: 17843 - protein, 107 aa, Artificial Sequence; identical to SEQ ID NO: 17838
  Description of Artificial Sequence: Synthetic polypeptide

SEQ ID NO: 17844 - protein, 107 aa, Artificial Sequence; identical to SEQ ID NO: 17838
  Description of Artificial Sequence: Synthetic polypeptide

SEQ ID NO: 17845 - protein, 107 aa, Artificial Sequence; identical to SEQ ID NO: 17838
  Description of Artificial Sequence: Synthetic polypeptide

SEQ ID NO: 17846 - protein, 107 aa, Artificial Sequence; identical to SEQ ID NO: 17838
  Description of Artificial Sequence: Synthetic polypeptide

SEQ ID NO: 17847 - protein, 108 aa, Artificial Sequence; identical to SEQ ID NO: 8839
  Description of Artificial Sequence: Synthetic polypeptide

SEQ ID NO: 17848 - protein, 108 aa, Artificial Sequence; identical to SEQ ID NO: 8840
  Description of Artificial Sequence: Synthetic polypeptide

SEQ ID NO: 17849 - protein, 107 aa, Artificial Sequence [sequence omitted]

SEQ ID NO: 17850 - protein, 107 aa, Artificial Sequence [sequence omitted]

SEQ ID NO: 17851 - protein, 107 aa, Artificial Sequence
  Description of Artificial Sequence: Synthetic polypeptide
DIQVTQSPSSLSASVGDRVTITCITSTDIDDDLNWYQQKPGKVPKLLISGGNTLRPGVPSRFSGSGSGTDFTLTISSLQPEDVATYYCLQSDSLPYTFGQGTKLEIK

SEQ ID NO: 17852 - protein, 107 aa, Artificial Sequence
  Description of Artificial Sequence: Synthetic polypeptide
DIQVTQSPSSLSASVGDRVTITCITSTDIDDDINWYQQKPGKVPKLLISGGNTLRPGVPSRFSGSGSGTDFTLTISSLQPEDVATYYCLQSDSLPYTFGQGTKLEIK

SEQ ID NO: 17853 - protein, 112 aa, Artificial Sequence
  Description of Artificial Sequence: Synthetic polypeptide
EIVMTQSPSTLSASVGDRVIITCQSSQSVYGNIWMAWYQQKPGRAPKLLIYQASKLASGVPSRFSGSGSGAEFTLTISSLQPDDFATYYCQGNFNTGDRYAFGQGTKLTVLK

SEQ ID NO: 17854 - protein, 111 aa, Artificial Sequence
  Description of Artificial Sequence: Synthetic polypeptide
EIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLK

SEQ ID NO: 17855 - protein, 108 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAAAYYCHQSSSLPFTFGPGTKVDIKR

SEQ ID NO: 17856 - protein, 108 aa, Artificial Sequence
  Description of Artificial Sequence: Synthetic polypeptide
SYELTQPLSVSVALGQTARITCSGDSIPNYYVYWYQQKPGQAPVLVIYDDSNRPSGIPERFSGSNSGNTATLTISRAQAGDEADYYCQSFDSSLNAEVFGGGTKLTVL

SEQ ID NO: 17857 - protein, 108 aa, Artificial Sequence
  Description of Artificial Sequence: Synthetic polypeptide
SYELTQPPSVSVAPGQTARISCSGDNLGSKYVDWYQQKPGQAPVLVIYSDNNRPSGIPERFSGSNSGNTATLTISGTQAEDEADYYCQTYTSGNNYLVFGGGTKLTVL

SEQ ID NO: 17858 - protein, 107 aa, Artificial Sequence; identical to SEQ ID NO: 17835
  Description of Artificial Sequence: Synthetic polypeptide

SEQ ID NO: 17859 - protein, 469 aa, Artificial Sequence
  Description of Artificial Sequence: Synthetic polypeptide
GGGGGPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPRIPKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCRVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 17860 - protein, 571 aa, Artificial Sequence
  Description of Artificial Sequence: Synthetic polypeptide
GGGGGPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPRIPKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCRVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 17861 - protein, 166 aa, Artificial Sequence
  Description of Artificial Sequence: Synthetic polypeptide
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 17862 - protein, 276 aa, Artificial Sequence
  Description of Artificial Sequence: Synthetic polypeptide
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDRGSGGGGVYHREAQSGKYYLTYAEAKAVCEFEGGHLATYKQLEAARKIGFHVCAAGWMAKGRVGYPIVKPGPNCGFGKTGIIDYGIRLNRSERWDAYCYNPHAGSHHHHHH

SEQ ID NO: 17863 - protein, 120 aa, Artificial Sequence
  Description of Artificial Sequence: Synthetic polypeptide
LPETGGGGGGSGGGGVYHREAQSGKYYLTYAEAKAVCEFEGGHLATYKQLEAARKIGFHVCAAGWMAKGRVGYPIVKPGPNCGFGKTGIIDYGIRLNRSERWDAYCYNPHAGGSHHHHHH

SEQ ID NO: 17864 - protein, 120 aa, Artificial Sequence; identical to SEQ ID NO: 17863
  Description of Artificial Sequence: Synthetic polypeptide

SEQ ID NO: 17865 - protein, 160 aa, Artificial Sequence
  Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 17866 - protein, 272 aa, Artificial Sequence
  Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGHHHHHH

SEQ ID NO: 17867 - protein, 432 aa, Artificial Sequence
  Description of Artificial Sequence: Synthetic polypeptide
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17868 - protein, 533 aa, Artificial Sequence
  Description of Artificial Sequence: Synthetic polypeptide
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGGVYHREAISGKYYLTYAEAKAVCEFEGGHLATYKQLEAAQQIGFHVCAAGWMAKGRVGYPIVKPGPNCGFGKTGIIDYGIRLQRSERWDAYCYNPHA

SEQ ID NO: 17869 - protein, 259 aa, Artificial Sequence
  Description of Artificial Sequence: Synthetic polypeptide
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLGGGGGGSGGGGSGGGGSSGGGSEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSHHHHHH

SEQ ID NO: 17870 - protein, 361 aa, Artificial Sequence
  Description of Artificial Sequence: Synthetic polypeptide
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLGGGGGGSGGGGSGGGGSSGGGSEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSSGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHAHHHHHH

SEQ ID NO: 17871 - protein, 142 aa, Artificial Sequence
  Description of Artificial Sequence: Synthetic polypeptide
SDLGKKLLEAARAGQDDEVRILMANGADVNTADSTGWTPLHLAVPWGHLEIVEVLLKYGADVNAKDFQGWTPLHLAAAIGHQEIVEVLLKNGADVNAQDKFGKTAFDISIDNGNEDLAEILQKAAGSLPETGGGSGHHHHHH

SEQ ID NO: 17872 - protein, 237 aa, Artificial Sequence
  Description of Artificial Sequence: Synthetic polypeptide
SDLGKKLLEAARAGQDDEVRILMANGADVNTADSTGWTPLHLAVPWGHLEIVEVLLKYGADVNAKDFQGWTPLHLAAAIGHQEIVEVLLKNGADVNAQDKFGKTAFDISIDNGNEDLAEILQKAAGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGHHHHHH

SEQ ID NO: 17873 - protein, 164 aa, Artificial Sequence
  Description of Artificial Sequence: Synthetic polypeptide
SDLGKKLLEAARAGQDDEVRILMANGADVNAFDWMGWTPLHLAAHEGHLEIVEVLLKNGADVNATDVSGYTPLHLAAADGHLEIVEVLLKYGADVNTKDNTGWTPLHLSADLGRLEIVEVLLKYGADVNAQDKFGKTAFDISIDNGNEDLAEILQKAAHHHHHH

SEQ ID NO: 17874 - protein, 270 aa, Artificial Sequence
  Description of Artificial Sequence: Synthetic polypeptide
SDLGKKLLEAARAGQDDEVRILMANGADVNAFDWMGWTPLHLAAHEGHLEIVEVLLKNGADVNATDVSGYTPLHLAAADGHLEIVEVLLKYGADVNTKDNTGWTPLHLSADLGRLEIVEVLLKYGADVNAQDKFGKTAFDISIDNGNEDLAEILQKAAGSGGGGVYHREAQSGKYKLTYAEAKAVCEFEGGHLATYKQLEAARKIGFHVCAAGWMAKGRVGYPIVKPGPNCGFGKTGIIDYGIRLNRSERWDAYCYNPHAGSGGHHHHHH

SEQ ID NO: 17875 - protein, 252 aa, Artificial Sequence
  Description of Artificial Sequence: Synthetic polypeptide
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLGGGGGSGGGGSGGGGSGGGGSEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 17876 - protein, 226 aa, Artificial Sequence
  Description of Artificial Sequence: Synthetic polypeptide
QVQLVQSGAEVKKPGSSVKVSCKASGYAFTNYLIEWVRQAPGQGLEWIGVIYPGSGGTNYNEKFKGRVTLTVDESTNTAYMELSSLRSEDTAVYFCARRDGNYGWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 17877 - protein, 214 aa, Artificial Sequence
  Description of Artificial Sequence: Synthetic polypeptide
DIQMTQTPSTLSASVGDRVTISCRASQDINNYLNWYQQKPGKAPKLLIYYTSTLHSGVPSRFSGSGSGTDYTLTISSLQPDDFATYFCQQGNTLPWTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17878 - protein, 226 aa, Artificial Sequence; identical to SEQ ID NO: 17876
  Description of Artificial Sequence: Synthetic polypeptide

SEQ ID NO: 17879 - protein, 194 aa, Artificial Sequence
  Description of Artificial Sequence: Synthetic polypeptide
DIQMTQTPSTLSASVGDRVTISCRASQDINNYLNWYQQKPGKAPKLLIYYTSTLHSGVPSRFSGSGSGTDYTLTISSLQPDDFATYFCQQGNTLPWTFGQGTKVEVKRTVAAPSVFIFPPSDEQLKSGTASVVCLLNNFYESVTEQDSKDSTYSLSSTLTLSKADYEKHKVYACEVTHQGLSSPVTKSFNRGEC

SEQ ID NO: 17880 - protein, 344 aa, Artificial Sequence
  Description of Artificial Sequence: Synthetic polypeptide
ILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17881 - protein, 451 aa, Artificial Sequence
  Description of Artificial Sequence: Synthetic polypeptide
EVQLVESGGGLVRPGGSLRLSCAASGFTFSNYDMHWVRQATGKGLEWVSAITAAGDIYYPGSVKGRFTISRENAKNSLYLQMNSLRAGDTAVYYCARGRYSGSGSYYNDWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17882 - protein, 447 aa, Artificial Sequence
  Description of Artificial Sequence: Synthetic polypeptide
EVQLVESGGGLVQPGGSLRLSCAASGFTFNNYAMNWVRQAPGKGLDWVSTISGSGGTTNYADSVKGRFIISRDSSKHTLYLQMNSLRAEDTAVYYCAKDSNWGNFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 17883 - protein, 450 aa, Artificial Sequence
  Description of Artificial Sequence: Synthetic polypeptide
EVQLQQSGAELVKPGASVKLSCTASGFNIKDTYVHWVKQRPEQGLEWIGRIDPANGYTKYDPKFQGKATITADTSSNTAYLQLSSLTSEDTAVYYCVRPLYDYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17884 - protein, 444 aa, Artificial Sequence
  Description of Artificial Sequence: Synthetic polypeptide
QVQLVQSGAEVKKPGASVKVSCKASGYTFTSYYMHWVRQAPGQGLEWMGEISPFGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17885 - protein, 453 aa, Artificial Sequence
  Description of Artificial Sequence: Synthetic polypeptide
EVQLVESGGGVIQPGGSLRLSCAASGFTFDDYAMNWVRQGPGKGLEWVSAISGDGGSTYYADSVKGRFTISRDNSKNSLYLQMNSLRAEDTAFFYCAKDLRNTIFGVVIPDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17886 - protein, 451 aa, Artificial Sequence; identical to SEQ ID NO: 17881
  Description of Artificial Sequence: Synthetic polypeptide

SEQ ID NO: 17887 - protein, 451 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 17888 - protein, 444 aa, Artificial Sequence
  Description of Artificial Sequence: Synthetic polypeptide
QVQLVQSGAEVKKPGASVKVSCKASGYTFTSYYMHWVRQAPGQGLEWMGEIHPSGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17889 - protein, 456 aa, Artificial Sequence
  Description of Artificial Sequence: Synthetic polypeptide
QVQLVESGGGVVQPGRSLRLSCTASGFTFKNYAMHWVRQAPAKGLEWVATISYDGRNIQYADSVKGRFTFSRDNSQDTLYLQLNSLRPEDTAVYYCARPVRSRWLQLGLEDAFHIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17890 - protein, 219 aa, Artificial Sequence
  Description of Artificial Sequence: Synthetic polypeptide
DVVMTQSPLSLPVTLGQPASISCKSSQSLLYTDGKTYLYWFLQRPGQSPRRLIYLVSKLDSGVPDRFSGSGSGTDFTLKISRVEAEDVGVYYCLQSTHFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17891 - protein, 451 aa, Artificial Sequence; identical to SEQ ID NO: 7277
  Description of Artificial Sequence: Synthetic polypeptide

SEQ ID NO: 17892 - protein, 225 aa, Artificial Sequence
  Description of Artificial Sequence: Synthetic polypeptide
QVQLQESGPGLVKPSETLSLTCTVSGFSLTSYIVDWIRQPPGKGLEWIGVIWAGGSTGYNSALRSRVSITKDTSKNQFSLKLSSVTAADTAVYYCASAAYYSYYNYDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 17893 - protein, 124 aa, Artificial Sequence
  Description of Artificial Sequence: Synthetic polypeptide
EVQLVESGGGLVRPGGSLRLSCAASGFTFSNYDMHWVRQATGKGLEWVSAITAAGDIYYPGSVKGRFTISRENAKNSLYLQMNSLRAGDTAVYYCARGRYSGSGSYYNDWFDPWGQGTLVTVSS

SEQ ID NO: 17894 - protein, 115 aa, Artificial Sequence
  Description of Artificial Sequence: Synthetic polypeptide
QVQLVQSGAEVKKPGASVKVSCKASGYIFSNYWIQWVRQAPGQGLEWMGEILPGSGSTEYAQKFQGRVTMTADTSTSTAYMELSSLRSEDTAVYYCARYFFGSSPNWYFVWGQGT

SEQ ID NO: 17895 - protein, 118 aa, Artificial Sequence [sequence omitted]

SEQ ID NO: 17896 - protein, 448 aa, Artificial Sequence
  Description of Artificial Sequence: Synthetic polypeptide
EVQLVESGGGLVKPGGSLRLSCAASGFTFSNYAMSWVRQTPEKRLEWVATISRSGSYSYFPDSVQGRFTISRDNAKNSLYLQMNSLRAEDTAVYYCARLGGYDEGDAMDSWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17897 - protein, 444 aa, Artificial Sequence; identical to SEQ ID NO: 17884
  Description of Artificial Sequence: Synthetic polypeptide

SEQ ID NO: 17898 - protein, 447 aa, Artificial Sequence; identical to SEQ ID NO: 17882
  Description of Artificial Sequence: Synthetic polypeptide

SEQ ID NO: 17899 - protein, 444 aa, Artificial Sequence; identical to SEQ ID NO: 17888
  Description of Artificial Sequence: Synthetic polypeptide

SEQ ID NO: 17900 - protein, 444 aa, Artificial Sequence
  Description of Artificial Sequence: Synthetic polypeptide
QVQLVQSGSELKKPGASVKVSCKASGYTFTDNNMDWVRQAPGQGLEWMGDINTRSGGSIYNEEFQDRVIMTVDKSTDTAYMELSSLRSEDTATYHCARRKSYGYYLDEWGEGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 17901 - protein, 448 aa, Artificial Sequence
  Description of Artificial Sequence: Synthetic polypeptide
QVQLVESGGGLVQPGGSLRLSCAASGFTFSYYDIQWVRQAPGKGLEWVSSISPSGQSTYYRREVKGRFTISRDNSKNTLYLQMNSLRAEDTAVYYCARRTGREYGGGWYFDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 17902 - protein, 448 aa, Artificial Sequence
  Description of Artificial Sequence: Synthetic polypeptide
QVQLVQSGAEVKKPGASVKVSCKASGYTFSTMYMSWVRQAPGQGLEWMGRIDPANEHTNYAQKFQGRVTMTRDTSISTAYMELSRLTSDDTAVYYCARSYYYYNMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17903 - protein, 441 aa, Artificial Sequence
  Description of Artificial Sequence: Synthetic polypeptide
EVQLVQSGAEVKKPGASVKVSCKASGYTLTSYGISWVRQAPGQGLEWMGWVSFYNGNTNYAQKLQGRGTMTTDPSTSTAYMELRSLRSDDTAVYYCARGYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 17904 - protein, 443 aa, Artificial Sequence
  Description of Artificial Sequence: Synthetic polypeptide
VIQPGGSLRLSCAASGFTFDDYAMNWVRQGPGKGLEWVSAISGDGGSTYYADSVKGRFTISRDNSKNSLYLQMNSLRAEDTAFFYCAKDLRNTIFGVVIPDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 17905 - protein, 449 aa, Artificial Sequence; identical to SEQ ID NO: 7290
  Description of Artificial Sequence: Synthetic polypeptide

SEQ ID NO: 17906 - protein, 456 aa, Artificial Sequence; identical to SEQ ID NO: 17889
  Description of Artificial Sequence: Synthetic polypeptide

SEQ ID NO: 17907 - protein, 225 aa, Artificial Sequence; identical to SEQ ID NO: 17892
  Description of Artificial Sequence: Synthetic polypeptide

SEQ ID NO: 17908 - protein, 696 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTEFAGAAAVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17909 - protein, 1684 aa, Artificial Sequence
  Description of Artificial Sequence: Synthetic polypeptide
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17910 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17911 - protein, 220 aa, Artificial Sequence
  Description of Artificial Sequence: Synthetic polypeptide
DIVMTQSPDSLAVSLGERATINCKSSQSVLYRSNNRNFLGWYQQKPGQPPNLLIYWASTRESGVPDRFSGSGSGTDFTLTISSLQAEDVAVYYCQQYYTTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17912 - protein, 214 aa, Artificial Sequence
  Description of Artificial Sequence: Synthetic polypeptide
DILMTQSPSSMSVSLGDTVSITCHASQGISSNIGWLQQKPGKSFMGLIYYGTNLVDGVPSRFSGSGSGADYSLTISSLDSEDFADYYCVQYAQLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 17913 - protein, 214 aa, Artificial Sequence
  Description of Artificial Sequence: Synthetic polypeptide
DIQMTQSPSSLSASVGDRVTITCRASQGISSALAWYQQKPGKAPKLLIYSASYRYTGVPSRFSGSGSGTDFTFTISSLQPEDIATYYCQQRYSLWRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17914 - protein, 214 aa, Artificial Sequence
  Description of Artificial Sequence: Synthetic polypeptide
DIQMTQSPSTLSASVGDRVTITCRASQSIRSWLAWYQQKPGKAPKLLIYKASSLESGVPSRFSGSGSGTEFTLTISSLQPDDFATYYCQQYNSYSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17915 - protein, 219 aa, Artificial Sequence; identical to SEQ ID NO: 17890
  Description of Artificial Sequence: Synthetic polypeptide

SEQ ID NO: 17916 - protein, 214 aa, Artificial Sequence; identical to SEQ ID NO: 17910
  Description of Artificial Sequence: Synthetic polypeptide

SEQ ID NO: 17917 - protein, 213 aa, Artificial Sequence
  Description of Artificial Sequence: Synthetic polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17918 - protein, 214 aa, Artificial Sequence
  Description of Artificial Sequence: Synthetic polypeptide
DIQMTQSPSSLSASVGDRVTITCKASQDVHTAVAWYQQKPGKAPKLLIYHASYRYTGVPSRFSGSGSGTDFTFTISSLQPEDIATYYCQQRYSLWRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17919 - protein, 214 aa, Artificial Sequence
  Description of Artificial Sequence: Synthetic polypeptide
AIRMTQSPSSFSASTGDRVTITCRASQDIRNYVAWYQQKSGKAPKFLIYAASTLQSGVPSRFSGSGSGTDFTLTINSLQSEDFATYYCQQYYNSPPTFGQGTRVEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17920 - protein, 214 aa, Artificial Sequence; identical to SEQ ID NO: 17914
  Description of Artificial Sequence: Synthetic polypeptide

SEQ ID NO: 17921 - protein, 450 aa, Artificial Sequence; identical to SEQ ID NO: 17883
  Description of Artificial Sequence: Synthetic polypeptide

SEQ ID NO: 17922 - protein, 214 aa, Artificial Sequence; identical to SEQ ID NO: 17912
  Description of Artificial Sequence: Synthetic polypeptide

SEQ ID NO: 17923 - protein, 107 aa, Artificial Sequence; identical to SEQ ID NO: 8229
  Description of Artificial Sequence: Synthetic polypeptide

SEQ ID NO: 17924 - protein, 106 aa, Artificial Sequence
  Description of Artificial Sequence: Synthetic polypeptide
DIQMTQSPSLSASVGDRVTITCGASENIYGALNWYQRKPGKAPKLLIYGATNLADGVPSRFSGSGSGTDYTLTISSLQPEDFATYYCQNVLNTPLTFGQGTKVEIK

SEQ ID NO: 17925 - protein, 113 aa, Artificial Sequence [sequence omitted]

SEQ ID NO: 17926 - protein, 216 aa, Artificial Sequence; identical to SEQ ID NO: 9470
  Description of Artificial Sequence: Synthetic polypeptide

SEQ ID NO: 17927 - protein, 213 aa, Artificial Sequence
  Description of Artificial Sequence: Synthetic polypeptide
QIVLTQSPATLSVSPGERATLSCRASQSVSYMHWYQQKPGQAPRLLIYGVFRRATGIPDRFSGSGSGTDFTLTIGRLEPEDFAVYYCLQWSSDPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17928 - protein, 214 aa, Artificial Sequence; identical to SEQ ID NO: 17913
  Description of Artificial Sequence: Synthetic polypeptide

SEQ ID NO: 17929 - protein, 220 aa, Artificial Sequence; identical to SEQ ID NO: 17911
  Description of Artificial Sequence: Synthetic polypeptide

SEQ ID NO: 17930 - protein, 214 aa, Artificial Sequence; identical to SEQ ID NO: 17918
  Description of Artificial Sequence: Synthetic polypeptide

SEQ ID NO: 17931 - protein, 214 aa, Artificial Sequence
  Description of Artificial Sequence: Synthetic polypeptide
DIQMTQSPSSLSASVGDRVTITCKASRNIERQLAWYQQKPGQAPELLIYQASRKESGVPDRFSGSRYGTDFTLTISSLQPEDIATYYCQQYSDPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17932 - protein, 219 aa, Artificial Sequence
  Description of Artificial Sequence: Synthetic polypeptide
DIVMTQTPLSLSVTPGQPASISCKSSQSLLESDGKTYLNWYLQKPGQSPQLLIYLVSILDSGVPDRFSGSGSGTDFTLKISRVEAEDVGVYYCLQATHFPQTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17933 - protein, 215 aa, Artificial Sequence
  Description of Artificial Sequence: Synthetic polypeptide
ESALTQPASVSGSPGQSITISCTGTSSDVGGYNSVSWYQQHPGKAPKLMIYEVSNRPSGVSNRFSGSKSGNTASLTISGLQAEDEADYYCNSYTSTSMVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 17934 - protein, 214 aa, Artificial Sequence; identical to SEQ ID NO: 9484
  Description of Artificial Sequence: Synthetic polypeptide

SEQ ID NO: 17935 - protein, 214 aa, Artificial Sequence; identical to SEQ ID NO: 17919
  Description of Artificial Sequence: Synthetic polypeptide

SEQ ID NO: 17936 - protein, 60 aa, Artificial Sequence
  Description of Artificial Sequence: Synthetic polypeptide
EAMHSFCAFKADDGPCRAAHPRWFFNIFTRQCEEFIYGGCEGNQNRFESLEECKKMCTRD

SEQ ID NO: 17937 - protein, 250 aa, Artificial Sequence
  Description of Artificial Sequence: Synthetic polypeptide
MADIQMTQSPSSLSASVGDRVTITCGASENIYGALNWYQRKPGKAPKLLIYGATNLADGVPSRFSGSGSGTDYTLTISSLQPEDFATYYCQNVLNTPLTFGQGTKVEIKRTGGGGSGGGGSGGGGSQVQLVQSGAEVEKPGASVKKVSCKASGYIFSNYWIQWVRQAPGQGLEWMGEILPGSGSTEYAQKFQGRVTMTADTSTSTAYMELSSLRSEDTAVYYCARYFFGSSPNYWYFDVWGQGTLVTVSS

SEQ ID NO: 17938 - protein, 34 aa, Artificial Sequence
  Description of Artificial Sequence: Synthetic polypeptide
  MOD_RES (29)..(29): Any amino acid
AVSEHQLLHDKGKSIQDLRRRELLEKLLXKLHTA

SEQ ID NO: 17939 - protein, 25 aa, Artificial Sequence
  Description of Artificial Sequence: Synthetic peptide
GGGGSGGGGSGGGGSGGGGSGGGGS

SEQ ID NO: 17940 - protein, 50 aa, Artificial Sequence
  Description of Artificial Sequence: Synthetic Polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 17941 - protein, 4 aa, Artificial Sequence
  Description of Artificial Sequence: Synthetic peptide
KDEL
